US012807954B2

(12) United States Patent
Mcininch et al.

(10) Patent No.: US 12,807,954 B2
(45) Date of Patent: Nov. 24, 2026

(54) COMPOSITIONS AND METHODS FOR SILENCING VEGF-A EXPRESSION

(71) Applicant: ALNYLAM PHARMACEUTICALS, INC., Cambridge, MA (US)

(72) Inventors: James D. Mcininch, Burlington, MA (US); Mark Keating, Weston, MA (US); Mark K. Schlegel, Lexington, MA (US); Adam Castoreno, Framingham, MA (US); Vasant R. Jadhav, Sharon, MA (US); Charalambos Kaittanis, Cambridge, MA (US); Elena Castellanos-Rizaldos, Melrose, MA (US); Bhaumik A. Pandya, Bedford, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 971 days.

(21) Appl. No.: 17/798,156

(22) PCT Filed: Feb. 9, 2021

(86) PCT No.: PCT/US2021/017276

§ 371 (c)(1),
(2) Date: Aug. 8, 2022

(87) PCT Pub. No.: WO2021/163066

PCT Pub. Date: Aug. 19, 2021

(65) Prior Publication Data

US 2023/0136787 A1 May 4, 2023

Related U.S. Application Data

(60) Provisional application No. 63/140,714, filed on Jan. 22, 2021, provisional application No. 63/055,627, filed on Jul. 23, 2020, provisional application No. 62/972,519, filed on Feb. 10, 2020.

(51) Int. Cl.

| | |
|---|---|
| ***C12N 15/113*** | (2010.01) |
| ***A61K 45/06*** | (2006.01) |
| ***A61P 27/02*** | (2006.01) |

(52) U.S. Cl.

CPC .......... *C12N 15/1136* (2013.01); *A61K 45/06* (2013.01); *A61P 27/02* (2018.01); *C12N 2310/14* (2013.01); *C12N 2310/3125* (2013.01); *C12N 2310/315* (2013.01); *C12N 2310/3515* (2013.01); *C12N 2320/32* (2013.01)

(58) Field of Classification Search

CPC ........... C12N 15/1136; C12N 2310/14; C12N 2310/3125; C12N 2310/315; C12N 2310/3515; C12N 2320/32; C12N 15/113; C12N 2310/32; C12N 2310/33; A61K 45/06; A61K 31/713; A61P 27/02

See application file for complete search history.

(56) References Cited

U.S. PATENT DOCUMENTS

| | | | |
|---|---|---|---|
| 3,228,831 | A | 1/1966 | Nicholson et al. |
| 3,687,808 | A | 8/1972 | Merigan, Jr. et al. |
| 3,904,682 | A | 9/1975 | Fried et al. |
| 4,009,197 | A | 2/1977 | Fried et al. |
| 4,426,330 | A | 1/1984 | Sears |
| 4,469,863 | A | 9/1984 | Ts'o et al. |
| 4,476,301 | A | 10/1984 | Imbach et al. |
| 4,534,899 | A | 8/1985 | Sears |
| 4,587,044 | A | 5/1986 | Miller et al. |
| 4,605,735 | A | 8/1986 | Miyoshi et al. |
| 4,667,025 | A | 5/1987 | Miyoshi et al. |
| 4,762,779 | A | 8/1988 | Snitman |
| 4,789,737 | A | 12/1988 | Miyoshi et al. |
| 4,824,941 | A | 4/1989 | Gordon et al. |
| 4,828,979 | A | 5/1989 | Klevan et al. |
| 4,835,263 | A | 5/1989 | Nguyen et al. |
| 4,837,028 | A | 6/1989 | Allen |
| 4,845,205 | A | 7/1989 | Huynh Dinh et al. |
| 4,876,335 | A | 10/1989 | Yamane et al. |
| 4,897,355 | A | 1/1990 | Eppstein et al. |
| 4,904,582 | A | 2/1990 | Tullis |
| 4,948,882 | A | 8/1990 | Ruth |
| 4,958,013 | A | 9/1990 | Letsinger |
| 4,981,957 | A | 1/1991 | Lebleu et al. |
| 5,013,556 | A | 5/1991 | Woodle et al. |
| 5,023,243 | A | 6/1991 | Tullis |

(Continued)

FOREIGN PATENT DOCUMENTS

| | | |
|---|---|---|
| EP | 0445131 | 4/1994 |
| EP | 0496813 | 12/1994 |

(Continued)

OTHER PUBLICATIONS

GenBank1, Accession BC065522, *Homo sapiens* vascular endothelial growth factor A, mRNA (cDNA clone Image:6006890), partial cds, https://www.ncbi.nlm.nih.gov/nuccore/BC065522.1, retrieved Aug. 12, 2025, printed as p. 1/1 to 1/3,. (Year: 2006).*

Official Action issued May 21, 2025 in Taiwan Patent Application No. 110105170, including translation.

International Search Report and Written Opinion issued Jul. 1, 2021 in PCT/US2021/017276.

(Continued)

*Primary Examiner* — Ekaterina Poliakova-Georgantas

*Assistant Examiner* — John Charles Mckillop

(74) *Attorney, Agent, or Firm* — Womble Bond Dickinson (US) LLP

(57) ABSTRACT

The disclosure relates to double-stranded ribonucleic acid (dsRNA) compositions targeting VEGF-A, and methods of using such dsRNA compositions to alter (e.g., inhibit) expression of VEGF-A.

20 Claims, 10 Drawing Sheets

Specification includes a Sequence Listing.

(56) References Cited

U.S. PATENT DOCUMENTS 5,032,401 A 7/1991 Jamas et al.
5,034,506 A 7/1991 Summerton et al.
5,082,830 A 1/1992 Brakel et al.
5,109,124 A 4/1992 Ramachandran et al.
5,112,963 A 5/1992 Pieles et al.
5,118,800 A 6/1992 Smith et al.
5,118,802 A 6/1992 Smith et al.
5,130,302 A 7/1992 Spielvogel et al.
5,134,066 A 7/1992 Rogers et al.
5,138,045 A 8/1992 Cook et al.
5,139,941 A 8/1992 Muzyczka et al.
5,166,315 A 11/1992 Summerton et al.
5,171,678 A 12/1992 Behr et al.
5,175,273 A 12/1992 Bischofberger et al.
5,177,195 A 1/1993 Gregory et al.
5,185,444 A 2/1993 Summerton et al.
5,188,897 A 2/1993 Suhadolnik et al.
5,213,804 A 5/1993 Martin et al.
5,214,134 A 5/1993 Weis et al.
5,214,136 A 5/1993 Lin et al.
5,216,141 A 6/1993 Benner
5,218,105 A 6/1993 Cook et al.
5,225,212 A 7/1993 Martin et al.
5,235,033 A 8/1993 Summerton et al.
5,245,022 A 9/1993 Weis et al.
5,252,479 A 10/1993 Srivastava
5,254,469 A 10/1993 Warren, III et al.
5,258,506 A 11/1993 Urdea et al.
5,262,536 A 11/1993 Hobbs, Jr.
5,264,221 A 11/1993 Tagawa et al.
5,264,423 A 11/1993 Cohen et al.
5,264,562 A 11/1993 Matteucci
5,264,564 A 11/1993 Matteucci
5,272,250 A 12/1993 Spielvogel et al.
5,276,019 A 1/1994 Cohen et al.
5,278,302 A 1/1994 Caruthers et al.
5,283,185 A 2/1994 Epand et al.
5,286,717 A 2/1994 Cohen et al.
5,292,873 A 3/1994 Rokita et al.
5,317,098 A 5/1994 Shizuya et al.
5,319,080 A 6/1994 Leumann
5,321,131 A 6/1994 Agrawal et al.
5,356,633 A 10/1994 Woodle et al.
5,359,044 A 10/1994 Cook et al.
5,367,066 A 11/1994 Urdea et al.
5,371,241 A 12/1994 Brush
5,391,723 A 2/1995 Priest
5,393,878 A 2/1995 Leumann
5,399,676 A 3/1995 Froehler
5,405,938 A 4/1995 Summerton et al.
5,405,939 A 4/1995 Suhadolnik et al.
5,414,077 A 5/1995 Lin et al.
5,416,203 A 5/1995 Letsinger
5,432,272 A 7/1995 Benner
5,434,257 A 7/1995 Matteucci et al.
5,436,146 A 7/1995 Shenk et al.
5,446,137 A 8/1995 Maag et al.
5,451,463 A 9/1995 Nelson et al.
5,453,496 A 9/1995 Caruthers et al.
5,455,233 A 10/1995 Spielvogel et al.
5,457,187 A 10/1995 Gmeiner et al.
5,459,255 A 10/1995 Cook et al.
5,466,677 A 11/1995 Baxter et al.
5,466,786 A 11/1995 Buhr et al.
5,470,967 A 11/1995 Huie et al.
5,476,925 A 12/1995 Letsinger et al.
5,484,908 A 1/1996 Froehler et al.
5,486,603 A 1/1996 Buhr
5,489,677 A 2/1996 Sanghvi et al.
5,502,177 A 3/1996 Matteucci et al.
5,510,475 A 4/1996 Agrawal et al.
5,512,439 A 4/1996 Hornes et al.
5,512,667 A 4/1996 Reed et al.
5,514,785 A 5/1996 Van Ness et al.
5,519,126 A 5/1996 Hecht
5,519,134 A 5/1996 Acevedo et al.
5,525,465 A 6/1996 Haralambidis et al.
5,525,711 A 6/1996 Hawkins et al.
5,536,821 A 7/1996 Agrawal et al.
5,539,082 A 7/1996 Nielsen et al.
5,540,935 A 7/1996 Miyazaki et al.
5,541,307 A 7/1996 Cook et al.
5,541,313 A 7/1996 Ruth
5,541,316 A 7/1996 Engelskirchen et al.
5,543,152 A 8/1996 Webb et al.
5,545,730 A 8/1996 Urdea et al.
5,550,111 A 8/1996 Suhadolnik et al.
5,552,538 A 9/1996 Urdea et al.
5,552,540 A 9/1996 Haralambidis
5,556,948 A 9/1996 Tagawa et al.
5,561,225 A 10/1996 Maddry et al.
5,563,253 A 10/1996 Agrawal et al.
5,565,552 A 10/1996 Magda et al.
5,567,810 A 10/1996 Weis et al.
5,567,811 A 10/1996 Misiura et al.
5,571,799 A 11/1996 Tkachuk et al.
5,574,142 A 11/1996 Meyer, Jr. et al.
5,576,427 A 11/1996 Cook et al.
5,578,717 A 11/1996 Urdea et al.
5,578,718 A 11/1996 Cook et al.
5,580,731 A 12/1996 Chang et al.
5,585,481 A 12/1996 Arnold, Jr. et al.
5,587,361 A 12/1996 Cook et al.
5,587,371 A 12/1996 Sessler et al.
5,587,469 A 12/1996 Cook et al.
5,591,584 A 1/1997 Chang et al.
5,591,722 A 1/1997 Montgomery et al.
5,594,121 A 1/1997 Froehler et al.
5,595,726 A 1/1997 Magda et al.
5,596,086 A 1/1997 Matteucci et al.
5,596,091 A 1/1997 Switzer
5,597,696 A 1/1997 Linn et al.
5,597,909 A 1/1997 Urdea et al.
5,599,923 A 2/1997 Sessler et al.
5,599,928 A 2/1997 Hemmi et al.
5,602,240 A 2/1997 De Mesmaeker et al.
5,607,677 A 3/1997 Jamas et al.
5,608,046 A 3/1997 Cook et al.
5,610,289 A 3/1997 Cook et al.
5,610,300 A 3/1997 Altmann et al.
5,614,617 A 3/1997 Cook et al.
5,618,704 A 4/1997 Sanghvi et al.
5,623,070 A 4/1997 Cook et al.
5,625,050 A 4/1997 Beaton et al.
5,627,053 A 5/1997 Usman et al.
5,633,360 A 5/1997 Bischofberger et al.
5,639,873 A 6/1997 Barascut et al.
5,646,265 A 7/1997 Mcgee
5,658,873 A 8/1997 Bertsch-Frank et al.
5,663,312 A 9/1997 Chaturvedula
5,665,557 A 9/1997 Murray et al.
5,665,710 A 9/1997 Rahman et al.
5,670,633 A 9/1997 Cook et al.
5,677,437 A 10/1997 Teng et al.
5,677,439 A 10/1997 Weis et al.
5,681,941 A 10/1997 Cook et al.
5,688,941 A 11/1997 Cook et al.
5,700,920 A 12/1997 Altmann et al.
5,705,188 A 1/1998 Junichi et al.
5,714,331 A 2/1998 Buchardt et al.
5,719,262 A 2/1998 Buchardt et al.
5,750,692 A 5/1998 Cook et al.
5,976,567 A 11/1999 Wheeler et al.
5,981,276 A 11/1999 Sodroski et al.
5,981,501 A 11/1999 Wheeler et al.
6,015,886 A 1/2000 Dale et al.
6,028,188 A 2/2000 Arnold, Jr. et al.
6,054,299 A 4/2000 Conrad
6,124,445 A 9/2000 Imbach et al.
6,143,520 A 11/2000 Marasco et al.
6,147,200 A 11/2000 Manoharan et al.
6,160,109 A 12/2000 Just et al.
6,166,197 A 12/2000 Cook et al.
6,169,170 B1 1/2001 Gryaznov et al.

(56) References Cited

U.S. PATENT DOCUMENTS 6,172,209 B1 1/2001 Manoharan et al.
6,191,105 B1 2/2001 Ekwuribe et al.
6,222,025 B1 4/2001 Cook et al.
6,235,887 B1 5/2001 Froehler et al.
6,239,265 B1 5/2001 Cook
6,268,490 B1 7/2001 Imanishi et al.
6,277,603 B1 8/2001 Cook
6,294,664 B1 9/2001 Ravikumar et al.
6,320,017 B1 11/2001 Ansell
6,326,199 B1 12/2001 Cook et al.
6,346,614 B1 2/2002 Metelev et al.
6,380,368 B1 4/2002 Froehler et al.
6,444,423 B1 9/2002 Meade et al.
6,525,191 B1 2/2003 Ramasamy
6,528,640 B1 3/2003 Beigelman et al.
6,531,590 B1 3/2003 Manoharan et al.
6,534,484 B1 3/2003 Wheeler et al.
6,534,639 B1 3/2003 Manoharan et al.
6,576,752 B1 6/2003 Manoharan et al.
6,586,410 B1 7/2003 Wheeler et al.
6,608,035 B1 8/2003 Agrawal et al.
6,617,438 B1 9/2003 Beigelman et al.
6,639,062 B2 10/2003 Manoharan et al.
6,670,461 B1 12/2003 Wengel et al.
6,683,167 B2 1/2004 Metelev et al.
6,747,014 B2 6/2004 Teng et al.
6,770,748 B2 8/2004 Imanishi et al.
6,783,931 B1 8/2004 Cook et al.
6,794,499 B2 9/2004 Wengel et al.
6,815,432 B2 11/2004 Wheeler et al.
6,858,225 B2 2/2005 Semple et al.
6,858,715 B2 2/2005 Ravikumar et al.
6,867,294 B1 3/2005 Sanghvi et al.
6,878,805 B2 4/2005 Manoharan et al.
6,887,906 B1 5/2005 Teng et al.
6,900,297 B1 5/2005 Cook et al.
6,998,484 B2 2/2006 Koch et al.
7,015,315 B1 3/2006 Cook et al.
7,034,133 B2 4/2006 Wengel et al.
7,037,646 B1 5/2006 Cook et al.
7,041,816 B2 5/2006 Ravikumar et al.
7,045,610 B2 5/2006 Dempcy et al.
7,053,207 B2 5/2006 Wengel
7,063,860 B2 6/2006 Chancellor et al.
7,070,802 B1 7/2006 Bhalani et al.
7,084,125 B2 8/2006 Wengel
RE39,464 E 1/2007 Cook et al.
7,157,099 B2 1/2007 Autuori et al.
7,273,933 B1 9/2007 Krotz et al.
7,321,029 B2 1/2008 Gryaznov et al.
7,399,845 B2 7/2008 Seth et al.
7,427,605 B2 9/2008 Davis et al.
7,427,672 B2 9/2008 Imanishi et al.
7,495,088 B1 2/2009 Brakel et al.
7,569,686 B1 8/2009 Bhat et al.
7,626,014 B2 12/2009 Manoharan et al.
7,741,457 B2 6/2010 Seth et al.
7,858,769 B2 12/2010 Jadhav et al.
8,022,193 B2 9/2011 Seth et al.
8,030,467 B2 10/2011 Seth et al.
8,058,069 B2 11/2011 Yaworski et al.
8,101,348 B2 1/2012 Tuschl et al.
8,106,022 B2 1/2012 Manoharan et al.
8,158,601 B2 4/2012 Chen et al.
8,278,283 B2 10/2012 Seth et al.
8,278,425 B2 10/2012 Prakash et al.
8,278,426 B2 10/2012 Seth et al.
8,293,719 B2 10/2012 De Fougerolles et al.
8,314,227 B2 11/2012 Wengel
8,753,625 B2 6/2014 Fung et al.
8,883,202 B2 11/2014 Manoharan et al.
2003/0027780 A1 2/2003 Hardee et al.
2004/0171570 A1 9/2004 Allerson et al.
2005/0226848 A1 10/2005 Kuwabara et al.
2005/0281781 A1 12/2005 Ostroff
2006/0240093 A1 10/2006 Maclachlan et al.
2007/0111963 A1 5/2007 Corey et al.
2007/0135372 A1 6/2007 Maclachlan et al.
2008/0039618 A1 2/2008 Allerson et al.
2009/0012281 A1 1/2009 Swayze et al.
2009/0023673 A1 1/2009 Manoharan et al.
2009/0247604 A1 10/2009 Tang et al.
2010/0324120 A1 12/2010 Chen et al.
2011/0313020 A1 12/2011 Templin et al.
2012/0029051 A1 2/2012 Smith et al.
2012/0101148 A1 4/2012 Aking et al.
2012/0157511 A1 6/2012 Manoharan et al.
2012/0322851 A1* 12/2012 Hardee ................ A61K 9/0053
514/44 R
2013/0011922 A1 1/2013 Quay et al.
2013/0096289 A1 4/2013 Wengel
2013/0190383 A1 7/2013 Vaish et al.
2017/0051290 A1* 2/2017 Byrne ................ C12N 15/1136
2017/0362594 A1 12/2017 Butler et al.
2022/0290152 A1 9/2022 Tu et al.
2023/0136787 A1 5/2023 Mcininch et al.

FOREIGN PATENT DOCUMENTS

JP 2009-532036 A 9/2009
JP 2011-500002 A 1/2011
JP 2013-539456 A 10/2013
WO WO 1988/04924 7/1988
WO WO 1990/04384 5/1990
WO WO 1991/05545 5/1991
WO WO 1991/16024 10/1991
WO WO 1993/24640 12/1993
WO WO 1993/24641 12/1993
WO WO 1994/00569 1/1994
WO WO 1994/02595 2/1994
WO WO 1994/12649 6/1994
WO WO 1994/13788 6/1994
WO WO 1994/20073 9/1994
WO WO 1996/10391 4/1996
WO WO 1996/37194 11/1996
WO WO 1996/40062 12/1996
WO WO 1996/40964 12/1996
WO WO 1997/04787 2/1997
WO WO 1997/13499 4/1997
WO WO 1997/30731 8/1997
WO WO 1998/39359 9/1998
WO WO 1999/14226 3/1999
WO WO 2000/03683 1/2000
WO WO 2000/22114 4/2000
WO WO 2000/66604 11/2000
WO 2005/028649 A1 3/2005
WO WO 2007/091269 8/2007
WO WO 2007/117686 10/2007
WO WO 2008/042973 4/2008
WO WO 2008/109362 9/2008
WO WO-2008109362 A1 * 9/2008 ......... C12N 15/1136
WO WO 2009/014887 1/2009
WO 2009/061417 A1 5/2009
WO WO 2009/082817 7/2009
WO WO 2009/127060 10/2009
WO WO 2010/011895 1/2010
WO WO 2010/048536 4/2010
WO WO 2010/054406 5/2010
WO WO 2010/088537 8/2010
WO WO 2010/129709 11/2010
WO WO 2010/141511 12/2010
WO WO 2010/144740 12/2010
WO WO 2011/005861 1/2011
WO WO 2011/031520 3/2011
WO WO 2011/119871 9/2011
WO WO 2011/133876 10/2011
WO 2012/015775 A3 2/2012
WO WO 2013/036868 3/2013
WO WO 2013/075035 5/2013
WO WO 2014/179620 11/2014
WO WO 2014/179627 11/2014
WO WO 2015/116658 8/2015
WO WO-2019014530 A1 * 1/2019 ........... C12N 15/113
WO WO 2019/055633 3/2019

(56) References Cited

FOREIGN PATENT DOCUMENTS

| | | |
|---|---|---|
| WO | WO 2019/217459 | 11/2019 |
| WO | WO 2020/132227 | 6/2020 |
| WO | WO 2020/257194 | 12/2020 |
| WO | WO 2000/22113 | 4/2022 |

OTHER PUBLICATIONS

Aigner, "Delivery Systems for the Direct Application of siRNAs to Induce RNA Interference (RNAi) In Vivo," J. Biomed. Biotechnol., 2006, 2006:71659, 15 pp.

Akaneya et al., "RNAi-Induced Gene Silencing by Local Electroporation in Targeting Brain Region," J. Neurophysiol., 2005, 93:594-602.

Akhtar et al., "Cellular uptake and intracellular fate of antisense oligonucleotides," Trends Cell. Biol., 1992, 2(5):139-144 (first page).

Allen et al., "Large unilamellar liposomes with low uptake into the reticuloendothelial system," FEBS Letters, 1987, 223(1):42-46.

Aoki et al., "Potential tumor-targeting peptide vector of histidylated oligolysine conjugated to a tumor-homing RGD motif," Cancer Gene Therapy, 2001, 8(10):783-787.

Arnold et al., "Specific beta1-adrenergic receptor silencing with small interfering RNA lowers high blood pressure and improves cardiac function in myocardial ischemia," J. Hypertens., 2007, 25(1):197-205.

Bangham et al., "Diffusion of Univalent Ions Across the Lamellae of Swollen Phospholipids," J. Mol. Biol., 1965, 13:238-252).

Bernstein et al., "Role for a bidentate ribonuclease in the initiation step of RNA interference," Nature, 2001, 409:363-366.

Bitko et al., "Inhibition of respiratory viruses by nasally administered siRNA," Nat. Med., 2005, 11:50-55.

Blume et al., "Liposomes for the sustained drug release in vivo," Biochimica et Biophysica Acta, 1990, 1029:91-97.

Boesen et al., "Circumvention of chemotherapy-induced myelosuppression by transfer of the mdr1 gene," Biotherapy, 1994, 6:291-302.

Bonnet et al., "Systemic Delivery of DNA or siRNA Mediated by Linear Polyethylenimine (L-PEI) Does Not Induce an Inflammatory Response," Pharm. Res., 2008, 25(12):2972-2982.

Bout et al., "Lung Gene Therapy: In Vivo Adenovirus-Mediated Gene Transfer to Rhesus Monkey Airway Epithelium," Hum. Gene Ther., 1994, 5:3-10.

Buur et al., "Penetration of 5-Fluorouracil and Prodrugs Across the Intestine of the Albino Rabbit: Evidence for Shift in Absorption Site from the Upper to the Lower Region of the Gastrointestinal Tract by Prodrugs," J. Control Rel., 1990, 14:43-51.

Chien et al., "Novel cationic cardiolipin analogue-based liposome for efficient DNA and small interfering RNA delivery in vitro and in vivo," Cancer Gene Ther., 2005, 12:321-328.

Chu et al., "Potent RNAi by short RNA triggers," RNA, 2008, 14:1714-1719.

Clowes et al., "Long-Term Biological Response of Injured Rat Carotid Artery Seeded with Smooth Muscle Cells Expressing Retrovirally Introduced Human Genes," J. Clin. Invest., 1994, 93:644-651.

Constantinides et al., "Formulation and Intestinal Absorption Enhancement Evaluation of Water-in-Oil Microemulsions Incorporating Medium-Chain Glycerides," Pharmaceutical Research, 1994, 11(10):1385-1390.

Couture et al., "Anti-gene therapy: the use of ribozymes to inhibit gene function," Trends in Genetics, 1996, 12(12):510-515.

Crooke et al., "Pharmacokinetic Properties of Several Novel Oligonucleotide Analogs in mice," J. Pharmacol. Exp. Ther., 1996, 277:923-937.

Docherty et al., "Nutrient regulation of insulin gene expression," Faseb J., 1994, 8:20-27.

Dorn et al., "siRNA relieves chronic neuropathic pain," Nucleic Acids, 2004, 32:e49, 6 pp.

Du Plessis et al., "Topical delivery of liposomally encapsulated gamma-interferon," Antiviral Research, 1992, 18:259-265.

Elbashir et al., "Functional anatomy of siRNAs for mediating efficient RNAi in *Drosophila melanogaster* embryo lysate," Embo J., 2001, 20(23):6877-6888.

Elbashir et al., "RNA interference is mediated by 21-and 22-nucleotide RNAs," Genes Dev., 2001, 15:188-200.

El-Hariri et al., "The Mitigating Effects of Phosphatidylcholines on Bile Salt- and Lysophosphatidylcholine-induced Membrane Damage," J. Pharm. Pharmacol., 1992, 44:651-654.

Elmén et al., "Locked nucleic acid (LNA) mediated improvements in siRNA stability and functionality," Nucleic Acids Research, 2005, 33(1):439-447.

Felgner et al., "Lipofection: A highly efficient, lipid-mediated DNA-transfection procedure," Proc. Natl. Acad. Sci. USA, 1987, 84:7413-7417.

Felgner et al., "Enhanced Gene Delivery and Mechanism Studies with a Novel Series of Cationic Lipid Formulations," J. Biol. Chem., 1994, 269(4):2550-2561.

Fluiter et al., "Filling the gap in LNA antisense oligo gapmers: the effects of unlocked nucleic acid (UNA) and 4'- C-hydroxymethyl-DNA modifications on RNase H recruitment and efficacy of an LNA gapmer," Mol. Biosyst., 2009, 5:838-843.

Fukunaga et al., "Liposome Entrapment Enhances the Hypocalcemic Action of Parenterally Administered Calcitonin," Endocrinol., 1984, 115(2):757-761.

Gabizon et al., "Liposome formulations with prolonged circulation time in blood and enhanced uptake by tumors," Proc. Natl. Acad. Sci. USA, 1988, 85:6949-6953.

Gao et al, "A Novel Cationic Liposome Reagent for Efficient Transfection of Mammalian Cells," Biochim. Biophys. Res. Commun., 1991, 179(1):280-285.

Gassmann et al., "Maintenance of an extrachromosomal plasmid vector in mouse embryonic stem cells," Proc. Natl. Acad. Sci. USA, 1995, 92:1292-1296.

Gershon et al., "Mode of Formation and Structural Features of DNA-Cationic Liposome Complexes Used for Transfection," Biochem., 1993, 32:7143-7151.

Grossman et al., "Retroviruses: delivery vehicle to the liver," Curr. Opin. in Genetics and Devel., 1993, 3:110-114.

Grünweller et al., "Comparison of different antisense strategies in mammalian cells using locked nucleic acids, 2'-O-methyl RNA, phosphorothioates and small interfering RNA," Nucleic Acids Research, 2003, 31(12):3185-3193.

Haubner et al., "Glycosylated RGD-Containing Peptides: Tracer for Tumor Targeting and Angiogenesis Imaging with Improved Biokinetics," J Nucl Med, 2001, 42:326-336.

Ho et al., "Preparation of Microemulsions Using Polyglycerol Fatty Acid Esters as Surfactant for the Delivery of Protein Drugs," J. Pharm. Sci., 1996, 85(2):138-143.

Howard et al., "RNA Interference in Vitro and in Vivo Using a Chitosan/siRNA Nanoparticle System," Mol. Ther., 2006, 14(4):476-484.

Hu et al., "Topical delivery of cyclosporin A from non-ionic liposomal systems : an in vivo/in vitro correlation study using hairless mouse skin," S.T.P. Pharma. Sci., 1994, 4(6):466-469.

Illum et al., "The organ uptake of intravenously administered colloidal particles can be altered using a non-ionic surfactant (Poloxamer 338)," FEBS Lett., 1984, 167(1):79-82.

Itani et al., "A simple and efficient liposome method for transfection of DNA into mammalian cells grown in suspension," Gene, 1987, 56:267-276.

Jackson et al., "Expression profiling reveals off-target gene regulation by RNAi," Nat. Biot., 2003, 21(6):635-637.

Jarrett, "Affinity chromatography with nucleic acid polymers," Chromatogr., 1993, 618:315-339.

Jensen et al., "Unlocked nucleic acid (UNA) and UNA derivatives: Thermal denaturation studies," Nuc. Acids Symp. Series, 2008, 52(1):133-134.

Kabanov et al., "A new class of antivirals: antisense oligonucleotides combined with a hydrophobic substituent effectively inhibit influenza virus reproduction and synthesis of virus-specific proteins in MDCK cells," FEBS Lett., 1990, 259(2):327-330.

(56) References Cited

OTHER PUBLICATIONS

Kiem et al., "Retrovirus-Mediated Gene Transduction Into Canine Peripheral Blood Repopulating Cells," Blood, 1994, 83(6):1467-1473.
Kim et al., "Cholesteryl Oligoarginine Delivering Vascular Endothelial Growth Factor siRNA Effectively Inhibits Tumor Growth in Colon Adenocarcinoma," Mol. Ther., 2006, 14(3):343-350.
Kim et al., "Local and systemic delivery of VEGF siRNA using polyelectrolyte complex micelles for effective treatment of cancer," Journal of Controlled Release, 2008, 129:107-116.
Kim et al., "Synthetic dsRNA Dicer substrates enhance RNAi potency and efficacy," Nat Biotech, 2005, 23(2):222-226.
Kim et al., "Preparation of Multivesicular Liposomes," Biochim. Biophys. Acta, 1983, 728:339-348.
Klibanov et al., "Amphipathic polyethyleneglycols effectively prolong the circulation time of liposomes," FEBS Lett., 1990, 268(1):235-237.
Kozarsky et al., "Gene therapy: adenovirus vectors," Current Opinion in Genetics and Development, 1993, 3:499-503.
Kubo et al., "Chemically modified symmetric and asymmetric duplex RNAs: an enhanced stability to nuclease degradation and gene silencing effect," Biochem. Biophys. Res. Comm., 2007, 365:54-61.
Lam et al., "A new type of synthetic peptide library for identifying ligand-binding activity," Nature, 1991, 354:82-84.
Lee et al., "Mucosal Penetration Enhancers For Facilitation of Peptide and Protein Drug Absorption," Critical Reviews in Therapeutic Drug Carrier Systems, 1991, 8(2):91-192.
Letsinger et al., "Cholesteryl-conjugated oligonucleotides: Synthesis, properties, and activity as inhibitors of replication of human immunodeficiency virus in cell culture," Proc. Natl. Acid. Sci. USA, 1989, 86:6553-6556.
Li et al., "Small dsRNAs induce transcriptional activation in human cells," Proc. Natl. Acad. Sci.,U.S.A., 2006, 103(46):17337-17342.
Li et al., "Polyethylenimine-complexed Plasmid Particles Targeting Focal Adhesion Kinase Function as Melanoma Tumor Therapeutics," Mol. Ther., 2007, 15(3):515-523.
Lima et al., "Single-Stranded siRNAs Activate RNAi in Animals," Cell, 2012, 150:883-894.
Lin et al., "A Cytosine Analogue Capable of Clamp-Like Binding to a Guanine in Helical Nucleic Acids," J. Am. Chem. Soc., 1998, 120:8531-8532.
Lin et al., "siRNA-mediated off-target gene silencing triggered by a 7 nt complementation," Nucleic Acids Res., 2005, 33(14):4527-4535.
Liu, "Radiolabeled Multimeric Cyclic RGD Peptides as Integrin $\alpha v\beta 3$ Targeted Radiotracers for Tumor Imaging," Mol. Pharm., 2006, 3(5):472-487.
Makimura et al., "Reducing hypothalamic AGRP by RNA interference increases metabolic rate and decreases body weight without influencing food intake," BMC Neurosci., 2002, 3:18, 6 pp.
Mannino et al., "Liposome Mediated Gene Transfer," Biotechniques, 1988, 6(7):682-690.
Manoharan et al., "Chemical Modifications to Improve Uptake and Bioavailability of Antisense Oligonucleotides," Ann. N.Y. Acad. Sci., 1992, 660:306-309.
Manoharan et al., "Introduction of a Lipophilic Thioether Tether in the Minor Groove of Nucleic Acids for Antisense Applications," Biorg. Med. Chem. Let., 1993, 3(12):2765-2770.
Manoharan et al., "Cholic Acid-Oligonucleotide Conjugates for Antisense Applications," Biorg. Med. Chem. Let., 1994, 4(8):1053-1060.
Manoharan et al., "Lipidic Nucleic Acids," Tetrahedron Lett., 1995, 36(21):3651-3654.
Manoharan et al., "Oligonucleotide Conjugates: Alteration of the Pharmacokinetic Properties of Antisense Agents," Nucleosides & Nucleotides, 1995, 14(3-5):969-973.
Martin et al., "A New Access to 2'-O-alkylated Ribonucleosides and Properties of 2'-O-Alkylated Oligoribonucleotides," Helv. Chim. Acta, 1995, 78:486-504 (with machine translation).
Mastrangeli et al., "Diversity of Airway Epithelial Cell Targets for In Vivo Recombinant Adenovirus-mediated Gene Transfer," J. Clin. Invest., 1993, 91:225-234.
Mayer et al., "Vesicles of variable sizes produced by a rapid extrusion procedure," Biochim. Biophys. Acta, 1986, 858:161-168.
Mayhew et al., "Characterization of Liposomes Prepared by Using a Microemulsifier," Biochim. Biophys. Acta, 1984, 775:169-174.
Mcnamara et al., "Cell type-specific delivery of siRNAs with aptamer-siRNA chimeras," Nat. Biotechnol., 2006, 24(8):1005-1015.
Mikhailov et al., "Synthesis of a New Class of Acyclic 2',5'- and 3',5'-Oligonucleotide Analogs Based on 9-[1,5-dihydroxy-4(S)-hydroxymethyl-3-oxapent-2(R)-yl]-adenine," Tetrahedron Letters, 1985, 26(17):2059-2062.
Miller et al., "Use of Retroviral Vectors for Gene Transfer and Expression," Meth. Enzymol., 1993, 217:581-599.
Mishra et al., "Improved leishmanicidal effect of phosphorotioate antisense oligonucleotides by LDL-mediated delivery," Biochim. Biophys. Acta, 1995, 1264:229-237.
Miyao et al., "Stability and Pharmacokinetic Characteristics of Oligonucleotides Modified at Terminal Linkages in Mice," Antisense Res Dev, 1995, 5:115-121.
Mook et al., "Evaluation of locked nucleic acid-modified small interfering RNA in vitro and in vivo," Mol Canc Ther, 2007, 6(3):833-843.
Muranishi, "Absorption Enhancers," Critical Reviews in Therapeutic Drug Carrier Systems, 1990, 7(1):1-33.
Nabel et al., "Direct gene transfer wit DNA-liposome complexes in melanoma: Expression, biologic activity, and lack of toxicity in humans," Proc. Natl. Acad. Sci. USA, 1993, 90:11307-11311.
Nabel et al., "Gene Transfer In Vivo with DNA-Liposome Complexes: Lack of Autoimmunity and Gonadal Localization," Human Gene Ther., 1992, 3:649-656.
NCBI Reference Sequence NM_001025250.3, "Mus musculus vascular endothelial growth factor A (Vegfa), transcript variant 1, mRNA," Nov. 16, 2007.
NCBI Reference Sequence NM_001110333.2, "Rattus norvegicus vascular endothelial growth factor A (Vegfa), transcript variant 2, mRNA," Nov. 27, 2013.
NCBI Reference Sequence NM_001171623.2, "*Homo sapiens* vascular endothelial growth factor A (VEGFA), transcript variant 1, mRNA," Jan. 31, 2021.
NCBI Reference Sequence XM_005552887.3, "Predicted: Macaca fascicularis vascular endothelial growth factor A (VEGFA), transcript variant X1, mRNA," Dec. 8, 2021.
Nicolau et al., "Liposomes as Carriers for in Vivo Gene Transfer and Expression," Meth. Enzymol., 1987, 149:157-176.
Nielsen et al., "Sequence-Selective Recognition of DNA by Strand Displacement with a Thymine-Substituted Polyamide," Science, 1991, 254(5037):1497-1500.
Nykänen et al., "ATP Requirements and Small Interfering RNA Structure in the RNA Interference Pathway," Cell, 2001, 107(3):309-321.
Oberhauser et al., "Effective incorporation of 2'-O-methyl-oligoribonucleotides into liposomes and enhanced cell association through modification with thiocholesterol," Nucl. Acids Res., 1992, 20(3):533-538.
Olson et al., "Preparation of liposomes of defined size distribution by extrusion through polycarbonate membranes," Biochim. Biophys. Acta, 1979, 557(1):9-23.
Pal et al., "Systemic delivery of RafsiRNA using cationic cardiolipin liposomes silences Raf-1 expression and inhibits tumor growth in xenograft model of human prostate cancer," Int J. Oncol., 2005, 26:1087-1091.
Papahadjopoulos et al., "Targeting of Liposomes to Tumor Cells in Vivo," Ann. N.Y. Acad. Sci., 1987, 507(1):64-74.
Pillé et al., "Anti-RhoA and Anti-RhoC siRNAs Inhibit the Proliferation and Invasiveness of MDA-MB-231 Breast Cancer Cells in Vitro and in Vivo," Mol. Ther., 2005, 11(2):267-274.
Rabinowitz et al., "Cross-Packaging of a Single Adeno-Associated Virus (AAV) Type 2 Vector Genome into Multiple AAV Serotypes Enables Transduction with Broad Specificity," J Virol, 2002, 76(2):791-801.

(56) References Cited

OTHER PUBLICATIONS

Reich et al., "Small interfering RNA (siRNA) targeting VEGF effectively inhibits ocular neovascularization in a mouse model," Mol. Vis., 2003, 9:210-216.
Ritschel, "Microemulsions for Improved Peptide Absorption from the Gastrointestinal Tract," Meth. Find. Exp. Clin. Pharmacol., 1991, 13(3):205-220.
Rosenfeld et al., "Adenovirus-Mediated Transfer of a Recombinant α1-Antitrypsin Gene to the Lung Epithelium in Vivo," Science, 1991, 252(5004):431-434.
Rosenfeld et al., "In Vivo Transfer of the Human Cystic Fibrosis Transmembrane Conductance Regulator Gene to the Airway Epithelium," Cell, 1992, 68:143-155.
Saison-Behmoaras et al., "Short modified antisense oligonucleotides directed against Ha-ras point mutation induce selective cleavage of the mRNA and inhibit T24 cells proliferation," Embo J, 1991, 10(5):1111-1118.
Salmons et al., "Targeting of Retroviral Vectors for Gene Therapy," Human Gene Therapy, 1993, 4:129-141.
Samulski et al., "A Recombinant Plasmid from Which an Infectious Adeno-Associated Virus Genome Can Be Excised In Vitro and Its Use To Study Viral Replication," J. Virol., 1987, 61(10):3096-3101.
Samulski et al., "Helper-Free Stocks of Recombinant Adeno-Associated Viruses: Normal Integration Does Not Require Viral Gene Expression," J. Virol., 1989, 63(9):3822-3826.
Sharp, "RNA interference—2001," Genes Dev., 2001, 15:485-490.
Shea et al., "Synthesis, hybridization properties and antiviral activity of lipid-oligodeoxynucleotide conjugates," Nucl. Acids Res., 1990, 18(13):3777-3783.
Shishkina et al., "Attenuation of α2A-Adrenergic Receptor Expression in Neonatal Rat Brain by RNA Interference or Antisense Oligonucleotide Reduced Anxiety in Adulthood," Neuroscience, 2004, 129:521-528.
Simeoni et al., "Insight into the mechanism of the peptide-based gene delivery system MPG: implications for delivery of siRNA into mammalian cells," Nucl. Acids Res., 2003, 31(11):2717-2724.
Sorensen et al., "Gene Silencing by Systemic Delivery of Synthetic siRNAs in Adult Mice," J. Mol. Biol., 2003, 327:761-766.
Soutschek et al., "Therapeutic silencing of an endogenous gene by systemic administration of modified siRNAs," Nature, 2004, 432:173-178.
Straubinger et al., "Liposomes as Carriers for Intracellular Delivery of Nucleic Acids," Meth. Enzymol., 1983, 101:512-527.
Strauss et al., "Molecular complementation of a collagen mutation in mammalian cells using yeast artificial chromosomes," Embo J., 1992, 11(2):417-422.
Sunamoto et al., "Liposomal Membranes. V. Interaction of Zinc(II) Ion with Egg Phosphatidylcholine Liposomes," Bull. Chem. Soc. Jpn., 1980, 53(10):2778-2781.
Svinarchuk et al., "Inhibition of HIV proliferation in MT-4 cells by antisense oligonucleotide conjugated to lipophilic groups," Biochimie, 1993, 75:49-54.
Szoka et al., "Procedure for preparation of liposomes with large internal aqueous space and high capture by reverse-phase evaporation," Proc. Natl. Acad. Sci., 1978, 75(9):4194-4198.
Takahashi et al., "The Use of a Perfluorochemical Emulsion as a Vascular Perfusate in Drug Absorption," J. Pharm. Pharmacol., 1988, 40:252-257.
Tan et al., "Gene knockdown with intrathecal siRNA of NMDA receptor NR2B subunit reduces formalin-induced nociception in the rat," Gene Ther., 2005, 12:59-66.
Tetko et al., "Prediction of n-Octanol/Water Partition Coefficients from PHYSPROP Database Using Artificial Neural Networks and E-State Indices," J. Chem. Inf. Comput. Sci., 2001, 41:1407-1421.
Thakker et al., "Neurochemical and behavioral consequences of widespread gene knockdown in the adult mouse brain by using nonviral RNA interference," Proc. Natl. Acad. Sci. U.S.A., 2004, 101(49):17270-17275.
Tolentino et al., "Intravitreal Injection of Vascular Endothelial Growth Factor Small Interfering RNA Inhibits Growth and Leakage in a Nonhuman Primate, Laser-Induced Model of Choroidal Neovascularization," Retina, 2004, 24(1):132-138.
Tomalia et al., "Dendrimers as multi-purpose nanodevices for oncology drug delivery and diagnostic imaging," Biochem. Soc. Trans., 2007, 35(1):61-67.
Verma et al., "Small Interfering RNAs Directed against-Catenin Inhibit the in Vitro and in Vivo Growth of Colon Cancer Cells," Clin. Cancer Res., 2003, 9:1291-1300.
Walsh et al., "Gene Therapy for Human Hemoglobinopathies," Proc. Soc. Exp. Biol. Med., 1993, 204(3):289-300.
Wang et al., "Plasmid DNA Adsorbed to pH-sensitive Liposomes Efficiently Transforms the Target Cells," Biochem. Biophys. Res. Commun., 1987, 147(3):980-985.
Wang et al., "A packaging cell line for propagation of recombinant adenovirus vectors containing two lethal gene-region deletions," Gene Therapy, 1995, 2:775-783.
Wang et al., "Cyclohexene Nucleic Acids (CeNA): Serum Stable Oligonucleotides that Activate RNase H and Increase Duplex Stability with Complementary RNA," J. Am. Chem. Soc., 2000, 122:8595-8602.
Weiner et al., "Liposomes: A Novel Topical Delivery System for Pharmaceutical and Cosmetic Applications," Journal of Drug Targeting, 1992, 2:405-410.
Wu et al., "Increased Microvascular Permeability Contributes to Preferential Accumulation of Stealth Liposomes in Tumor Tissue," Cancer Research, 1993, 53:3765-3770.
Xia et al., "siRNA-mediated gene silencing in vitro and in vivo," Nat. Biotech., 2002, 20:1006-1010.
Yamamoto et al., "A Mechanistic Study on Enhancement of Rectal Permeability to Insulin in the Albino Rabbit," J. Pharm. Exp. Ther., 1992, 263(1):25-31.
Yamashita et al., "Effects of diclofenac sodium and disodium ethylenediaminetetraacetate on electrical parameters of the mucosal membrane and their relation to the permeability enhancing effects in the rat jejunum," J. Pharm. Pharmacol., 1987, 39:621-626.
Yamashita et al., "Effect of Adjuvants on Charge-Selective Permeability and Electrical Resistance of Rat Jejunal Membrane," J. Pharm. Sci., 1990, 79(7):579-583.
Yoo et al., "PAMAM Dendrimers as Delivery Agents for Antisense Oligonucleotides," Pharm. Res., 1999, 16:1799-1804.
Zhang et al., "Small Interfering RNA Targeting Heme Oxygenase-1 Enhances Ischemia-Reperfusion-induced Lung Apoptosis," J. Biol. Chem., 2004, 279(11):10677-10684.
Zhou et al., "Lipophilic polylysines mediate efficient DNA transfection in mammalian cells," Biochim. Biophys. Acta, 1991, 1065:8-14.
Zhou et al., "Targeted delivery of DNA by liposomes and polymers," Journal of Controlled Release, 1992, 19:269-274.
Zhou et al., "Fine Tuning of Electrostatics around the Internucleotidic Phosphate through Incorporation of Modified 2',4'-Carbocyclic-LNAs and -ENAs Leads to Significant Modulation of Antisense Properties," J. Org. Chem., 2009, 74:118-134.
Zimmermann et al., "RNAi-mediated gene silencing in non-human primates," Nature, 2006, 441:111-114.
Zitzmann et al., " Arginine-glycine-aspartic acid (RGD)-peptide binds to both tumor and tumor endothelial cells in vivo.," Cancer Res., 2002, 62:5139-5143.
Opposition issued Mar. 10, 2023 in Colombian Patent Application No. NC2022/0012865.
Official Action issued Feb. 9, 2023 in Moroccan Patent Application No. 57560.
Official Action issued Jan. 8, 2024 in Chilean Patent Application No. 02159-2022, including translation.
Official Action issued Oct. 9, 2024 in Chilean Patent Application No. 02159-2022, including translation.
Official Action issued Jun. 7, 2024 in Eurasian Patent Application No. 202292304.
Official Action issued Oct. 1, 2024 in Moroccan Patent Application No. 57560, including translation.
Official Action issued Jul. 16, 2023 in Saudi Patent Application No. 522440089, including translation.
Official Action and Search Report issued Oct. 17, 2024 in Taiwan Patent Application No. 110105170, including translation.

(56) References Cited

OTHER PUBLICATIONS

Official Action and Search Report issued Dec. 12, 2024 in United Arab Emirates Patent Application No. P6001544/2022.
Official Action issued Mar. 25, 2025 in Japanese Patent Application No. 2022-548542, including translation.
Lu et al., "Modulation of angiogenesis with siRNA inhibitors for novel therapeutics," Trends in Molecular Medicine, 2005, 11(3):104-113.
Passioura et al., "Interfering ribonucleic acids that suppress expression of multiple unrelated genes," BMC Biotechnology, 2009, 9:57, 11 pp.
Shen and Corey, "Chemistry, mechanism and clinical status of antisense oligonucleotides and duplex RNAs," Nucleic Acids Research, 2018, 46(4):1584-1600.
Vumbaca et al., "Double-Stranded RNA-Binding Protein Regulates Vascular Endothelial Growth Factor mRNA Stability, Translation, and Breast Cancer Bngiogenesis," Molecular and Cellular Biology, 2008, 28(2):772-783.
Wang et al., "siRNA-mediated knockdown of VEGF-A, VEGF-C and VEGFR-3 suppresses the growth and metastasis of mouse bladder carcinoma in vivo," Experimental and Therapeutic Medicine, 2010, 1:899-904.
Watts and Corey, "Clinical Status of Duplex RNA," Bioorg Med Chem Lett, 2010, 20(11):3203-3207.
Official Action issued Dec. 18, 2025 in Chilean Patent Application No. 202402001, including translation.
Official Action issued Nov. 19, 2025 in Colombian Patent Application No. NC2022/0012865, including translation.
Search Report issued Nov. 28, 2025 in Eurasian Application No. 202591440, including translation.
Official Action issued Nov. 18, 2025 in Japanese Patent Application No. 2022-548542, including translation.
Official Action issued Sep. 29, 2025 in Saudi Patent Application No. 523451174, including translation.
Official Action issued Jan. 15, 2026 in Saudi Patent Application No. 523451174, including translation.
Official Action issued Aug. 13, 2025 in Vietnamese Patent Application No. 1-2022-05608, including translation.

* cited by examiner

COMPOSITIONS AND METHODS FOR SILENCING VEGF-A EXPRESSION

RELATED APPLICATIONS

This application claims priority to U.S. provisional application No. 62/972,519, filed on Feb. 10, 2020, U.S. provisional application No. 63/055,627, filed on Jul. 23, 2020, and U.S. provisional application No. 63/140,714, filed on Jan. 22, 2021. The entire contents of the foregoing applications are hereby incorporated herein by reference.

SEQUENCE LISTING

The instant application contains a Sequence Listing which has been submitted electronically in ASCII format and is hereby incorporated by reference in its entirety. Said ASCII copy, created on Feb. 4, 2021, is named A2038-7236WO_SL.txt and is 1,327,255 bytes in size.

FIELD OF THE DISCLOSURE

The disclosure relates to the specific inhibition of the expression of the VEGF-A.

BACKGROUND

Vascular eye diseases are the leading cause of vision loss in today's aging population, including exudative age-related macular degeneration (exudative AMD), retinal vein occlusion (RVO), retinopathy of prematurity (ROP), diabetic retinopathy (DR), and diabetic macular edema (DME). Several of these ocular disorders are associated with pathological angiogenesis. The release of vascular endothelial growth factors (VEGFs) contributes to increased vascular permeability and inappropriate new vessel growth in the eye. New treatments for angiogenic ocular disorders are needed.

SUMMARY

The present disclosure describes methods and iRNA compositions for modulating the expression of VEGF-A. In certain embodiments, expression of VEGF-A is reduced or inhibited using a VEGF-A-specific iRNA. Such inhibition can be useful in treating disorders related to VEGF-A expression, such as ocular disorders (e.g., age-related macular degeneration (AMD), macular edema following retinal vein occlusion (MEfRVO) or central retinal vein occlusion (CVO), retinopathy of prematurity (ROP), diabetic macular edema (DME), and diabetic retinopathy (DR)).

Accordingly, described herein are compositions and methods that effect the RNA-induced silencing complex (RISC)-mediated cleavage of RNA transcripts of VEGF-A, such as in a cell or in a subject (e.g., in a mammal, such as a human subject). Also described are compositions and methods for treating a disorder related to expression of VEGF-A, such as an angiogenic ocular disorder (e.g., AMD, RVO, MEfRVO, CVO, ROP, DME, mCNV, and DR)).

The iRNAs (e.g., dsRNAs) included in the compositions featured herein include an RNA strand (the antisense strand) having a region, e.g., a region that is 30 nucleotides or less, generally 19-24 nucleotides in length, that is substantially complementary to at least part of an mRNA transcript of VEGF-A (e.g., a human VEGF-A) (also referred to herein as a "VEGF-A-specific iRNA"). In some embodiments, the VEGF-A mRNA transcript is a human VEGF-A mRNA transcript, e.g., SEQ ID NO: 1 herein.

In some embodiments, the iRNA (e.g., dsRNA) described herein comprises an antisense strand having a region that is substantially complementary to a region of a human VEGF-A mRNA. In some embodiments, the human VEGF-A mRNA has the sequence NM_001171623.1 (SEQ ID NO: 1). The sequence of NM_001171623.1 is also herein incorporated by reference in its entirety. The reverse complement of SEQ ID NO: 1 is provided as SEQ ID NO: 2 herein.

In some aspects, the present disclosure provides a double stranded ribonucleic acid (dsRNA) agent for inhibiting expression of vascular endothelial growth factor A (VEGF-A), wherein the dsRNA agent comprises a sense strand and an antisense strand forming a double stranded region, wherein the sense strand comprises a nucleotide sequence comprising at least 15 contiguous nucleotides, with 0, 1, 2, or 3 mismatches, of a portion of a coding strand of human VEGF-A and the antisense strand comprises a nucleotide sequence comprising at least 15 contiguous nucleotides, with 0, 1, 2, or 3 mismatches, of the corresponding portion of a non-coding strand of human VEGF-A such that the sense strand is complementary to the at least 15 contiguous nucleotides in the antisense strand.

In some aspects, the present disclosure provides a double stranded ribonucleic acid (dsRNA) agent for inhibiting expression of VEGF-A, wherein the dsRNA agent comprises a sense strand and an antisense strand forming a double stranded region, wherein the antisense strand comprises a nucleotide sequence comprising at least 15 contiguous nucleotides, with 0, 1, 2, or 3 mismatches, of a portion of nucleotide sequence of SEQ ID NO: 2 such that the sense strand is complementary to the at least 15 contiguous nucleotides in the antisense strand.

In some aspects, the present disclosure provides a human cell or tissue comprising a reduced level of VEGF-A mRNA or a level of VEGF-A protein as compared to an otherwise similar untreated cell or tissue, wherein optionally the cell or tissue is not genetically engineered (e.g., wherein the cell or tissue comprises one or more naturally arising mutations, e.g., VEGF-A), wherein optionally the level is reduced by at least 10%, 15%, 20%, 25%, 30%, 35%, 40%, 45%, 50%, 55%, 60%, 65%, 70%, 75%, 80%, 85%, 90%, or 95%. In some embodiments, the human cell or tissue is a retinal pigment epithelium (RPE), a retinal tissue, an astrocyte, a pericyte, a Müller cell, a ganglion cell, an endothelial cell, a photoreceptor cell, a retinal blood vessel (e.g., including endothelial cells and vascular smooth muscle cells), or choroid tissue, e.g., a choroid vessel.

The present disclosure also provides, in some aspects, a cell containing the dsRNA agent described herein.

In another aspect, provided herein is a human ocular cell, e.g., (an RPE cell, a retinal cell, an astrocyte, a pericyte, a Müller cell, a ganglion cell, an endothelial cell, or a photoreceptor cell) comprising a reduced level of VEGF-A mRNA or a level of VEGF-A protein as compared to an otherwise similar untreated cell. In some embodiments, the level is reduced by at least 10%, 15%, 20%, 25%, 30%, 35%, 40%, 45%, 50%, 55%, 60%, 65%, 70%, 75%, 80%, 85%, 90%, or 95%.

In some aspects, the present disclosure also provides a pharmaceutical composition for inhibiting expression of a gene encoding VEGF-A, comprising a dsRNA agent described herein.

The present disclosure also provides, in some aspects, a method of inhibiting expression of VEGF-A in a cell, the method comprising:

(a) contacting the cell with the dsRNA agent described herein, or a pharmaceutical composition described herein; and (b) maintaining the cell produced in step (a) for a time sufficient to obtain degradation of the mRNA transcript of VEGF-A, thereby inhibiting expression of the VEGF-A in the cell.

The present disclosure also provides, in some aspects, a method of inhibiting expression of VEGF-A in a cell, the method comprising:

(a) contacting the cell with the dsRNA agent described herein, or a pharmaceutical composition described herein; and (b) maintaining the cell produced in step (a) for a time sufficient to reduce levels of VEGF-A mRNA, VEGF-A protein, or both of VEGF-A mRNA and protein, thereby inhibiting expression of the VEGF-A in the cell.

The present disclosure also provides, in some aspects, a method of inhibiting expression of VEGF-A in an ocular cell or tissue, the method comprising:

(a) contacting the cell or tissue with a dsRNA agent that binds VEGF-A; and (b) maintaining the cell or tissue produced in step (a) for a time sufficient to reduce levels of VEGF-A mRNA, VEGF-A protein, or both of VEGF-A mRNA and protein, thereby inhibiting expression of VEGF-A in the cell or tissue.

The present disclosure also provides, in some aspects, a method of treating a subject diagnosed with VEGF-A-associated disorder comprising administering to the subject a therapeutically effective amount of the dsRNA agent described herein or a pharmaceutical composition described herein, thereby treating the disorder.

In any of the aspects herein, e.g., the compositions and methods above, any of the embodiments herein (e.g., below) may apply.

In some embodiments, the coding strand of human VEGF-A has the sequence of SEQ ID NO: 1. In some embodiments, the non-coding strand of human VEGF-A has the sequence of SEQ ID NO: 2.

In some embodiments, the sense strand comprises a nucleotide sequence comprising at least 15 contiguous nucleotides, with 0, or 1, 2, or 3 mismatches, of the corresponding portion of the nucleotide sequence of SEQ ID NO: 1.

In some embodiments, the dsRNA agent comprises a sense strand and an antisense strand, wherein the antisense strand comprises a nucleotide sequence comprising at least 17 contiguous nucleotides, with 0, 1, 2, or 3 mismatches, of a portion of nucleotide sequence of SEQ ID NO: 2 such that the sense strand is complementary to the at least 17 contiguous nucleotides in the antisense strand. In some embodiments, the sense strand comprises a nucleotide sequence comprising at least 17 contiguous nucleotides, with 0, or 1, 2, or 3 mismatches, of the corresponding portion of the nucleotide sequence of SEQ ID NO: 1.

In some embodiments, the dsRNA agent comprises a sense strand and an antisense strand, wherein the antisense strand comprises a nucleotide sequence comprising at least 19 contiguous nucleotides, with 0, 1, 2, or 3 mismatches, of a portion of nucleotide sequence of SEQ ID NO: 2 such that the sense strand is complementary to the at least 19 contiguous nucleotides in the antisense strand. In some embodiments, the sense strand comprises a nucleotide sequence comprising at least 19 contiguous nucleotides, with 0, 1, 2, or 3 mismatches, of the corresponding portion of the nucleotide sequence of SEQ ID NO: 1.

In some embodiments, the dsRNA agent comprises a sense strand and an antisense strand, wherein the antisense strand comprises a nucleotide sequence comprising at least 21 contiguous nucleotides, with 0, 1, 2, or 3 mismatches, of a portion of nucleotide sequence of SEQ ID NO: 2 such that the sense strand is complementary to the at least 21 contiguous nucleotides in the antisense strand. In some embodiments, the sense strand comprises a nucleotide sequence comprising at least 21 contiguous nucleotides, with 0, or 1, 2, or 3 mismatches, of the corresponding portion of the nucleotide sequence of SEQ ID NO: 1.

In some embodiments, the portion of the sense strand is a portion within nucleotides 1855-1875, 1858-1878, 2178-2198, 2181-2201, 2944-2964, 2946-2966, 2952-2972, 3361-3381, or 3362-3382 of SEQ ID NO: 1. In some embodiments, the portion of the sense strand is a portion corresponding to SEQ ID NO: 4200, 4201, 4202, 4203, 4204, 4205, 4206, 4207, 4208, 4209, 4210, or 4211.

In some embodiments, the portion of the sense strand is a portion within a sense strand in any one of Tables 2A, 2B, 3A, 3B, 4A, 4B, 5A, 5B, 8A, 8B, 10A, 10B, 12, 13, 14, 18A and 18B.

In some embodiments, the portion of the antisense strand is a portion within an antisense strand in any one of Tables 2A, 2B, 3A, 3B, 4A, 4B, 5A, 5B, 8A, 8B, 10A, 10B, 12, 13, 14, 18A and 18B.

In some embodiments, the antisense strand comprises a nucleotide sequence comprising at least 15 contiguous nucleotides, with 0, 1, 2, or 3 mismatches, from one of the antisense sequences listed in any one of Tables 2A, 2B, 3A, 3B, 4A, 4B, 5A, 5B, 8A, 8B, 10A, 10B, 12, 13, 14, 18A and 18B. In some embodiments, the sense strand comprises a nucleotide sequence comprising at least 15 contiguous nucleotides, with 0, 1, 2, or 3 mismatches, from a sense sequence listed in any one of Tables 2A, 2B, 3A, 3B, 4A, 4B, 5A, 5B, 8A, 8B, 10A, 10B, 12, 13, 14, 18A and 18B that corresponds to the antisense sequence.

In some embodiments, the antisense strand comprises a nucleotide sequence comprising at least 17 contiguous nucleotides, with 0, 1, 2, or 3 mismatches, from one of the antisense sequences listed in any one of Tables 2A, 2B, 3A, 3B, 4A, 4B, 5A, 5B, 8A, 8B, 10A, 10B, 12, 13, 14, 18A and 18B. In some embodiments, the sense strand comprises a nucleotide sequence comprising at least 17 contiguous nucleotides, with 0, 1, 2, or 3 mismatches, from a sense sequence listed in any one of Tables 2A, 2B, 3A, 3B, 4A, 4B, 5A, 5B, 8A, 8B, 10A, 10B, 12, 13, 14, 18A and 18B that corresponds to the antisense sequence.

In some embodiments, the antisense strand comprises a nucleotide sequence comprising at least 19 contiguous nucleotides, with 0, 1, 2, or 3 mismatches, from one of the antisense sequences listed in any one of Tables 2A, 2B, 3A, 3B, 4A, 4B, 5A, 5B, 8A, 8B, 10A, 10B, 12, 13, 14, 18A and 18B. In some embodiments, the sense strand comprises a nucleotide sequence comprising at least 19 contiguous nucleotides, with 0, 1, 2, or 3 mismatches, from a sense sequence listed in any one of Tables 2A, 2B, 3A, 3B, 4A, 4B, 5A, 5B, 8A 8B, 10A, 10B, 12, 13, 14, 18A and 18B that corresponds to the antisense sequence.

In some embodiments, the antisense strand comprises a nucleotide sequence comprising at least 21 contiguous nucleotides, with 0, 1, 2, or 3 mismatches, from one of the antisense sequences listed in any one of Tables 2A, 2B, 3A, 3B, 4A, 4B, 5A, 5B, 8A, 8B, 10A, 10B, 12, 13, 14, 18A and 18B. In some embodiments, the sense strand comprises a nucleotide sequence comprising at least 21 contiguous nucleotides, with 0, 1, 2, or 3 mismatches, from a sense sequence listed in any one of Tables 2A, 2B, 3A, 3B, 4A, 4B, 5A, 5B, 8A 8B, 10A, 10B, 12, 13, 14, 18A and 18B that corresponds to the antisense sequence.

In some embodiments, the sense strand of the dsRNA agent is at least 23 nucleotides in length, e.g., 23-30 nucleotides in length.

In some embodiments, the portion of the sense strand is a portion within a sense strand from a duplex chosen from AD-1020574 (CGACAGAACAGUCCUUAAUCA (SEQ ID NO: 4200)), AD-901094 (CAGAACAGUCCUUAAUCCAGA (SEQ ID NO: 4201)), AD-1020575 (CAGAACAGUCCUUAAUCCAGA (SEQ ID NO: 4202)), AD-901100 (AACAGUGCUAAUGUUAUUGGA (SEQ ID NO: 4203)), AD-901101 (AGUGCUAAUGUUAUUGGUGUA (SEQ ID NO: 4204)), AD-901113 (GAGAAAGUGUUUUAUAUACGA (SEQ ID NO: 4205)), AD-901123 (AAAAUAGACAUUGCUAUUCUA (SEQ ID NO: 4206)), AD-901124 (AAAUAGACAUUGCUAUUCUGA (SEQ ID NO: 4207)), AD-901158 (GAAAGUGUUUUAUAUACGGUA (SEQ ID NO: 4208)), AD-901159 (GUUUUAUAUACGGUACUUAUA (SEQ ID NO: 4209)), AD-1020573 (AGUGCUAATGTUAUUGGUGUA (SEQ ID NO: 4210)), or AD-1023143 (AAAAUAGACATUGCUAUUCUA (SEQ ID NO: 4211)). In some embodiments, the portion is a portion of a corresponding chemically modified sequence provided in Tables 2A, 3A, 4A, or Table 18A.

In some embodiments, the portion of the sense strand is a sense strand chosen from the sense strands of AD-1020574 (CGACAGAACAGUCCUUAAUCA (SEQ ID NO: 4200)), AD-901094 (CAGAACAGUCCUUAAUCCAGA (SEQ ID NO: 4201)), AD-1020575 (CAGAACAGUCCUUAAUCCAGA (SEQ ID NO: 4202)), AD-901100 (AACAGUGCUAAUGUUAUUGGA (SEQ ID NO: 4203)), AD-901101 (AGUGCUAAUGUUAUUGGUGUA (SEQ ID NO: 4204)), AD-901113 (GAGAAAGUGUUUUAUAUACGA (SEQ ID NO: 4205)), AD-901123 (AAAAUAGACAUUGCUAUUCUA (SEQ ID NO: 4206)), AD-901124 (AAAUAGACAUUGCUAUUCUGA (SEQ ID NO: 4207)), AD-901158 (GAAAGUGUUUUAUAUACGGUA (SEQ ID NO: 4208)), AD-901159 (GUUUUAUAUACGGUACUUAUA (SEQ ID NO: 4209)), AD-1020573 (AGUGCUAATGTUAUUGGUGUA (SEQ ID NO: 4210)), or AD-1023143 (AAAAUAGACATUGCUAUUCUA (SEQ ID NO: 4211)). In some embodiments, the portion is a portion of a corresponding chemically modified sequence provided in Tables 2A, 3A, 4A, or Table 18A.

In some embodiments, the portion of the sense strand is a portion within a sense strand from a duplex chosen from AD-953374 (SEQ ID NO: 813), AD-953504 (SEQ ID NO: 1297), AD-953481 (SEQ ID NO: 1298), AD-953351 (SEQ ID NO: 800), AD-901356 (SEQ ID NO: 261), AD-953344 (SEQ ID NO: 787), AD-901355 (SEQ ID NO: 262), AD-953410 (SEQ ID NO: 845), AD-953363 (SEQ ID NO: 779), AD-953411 (SEQ ID NO: 844), AD-953350 (SEQ ID NO: 784), or AD-953375 (SEQ ID NO: 790). In some embodiments, the portion is a portion of a corresponding chemically modified sequence provided in Tables 2A, 3A, 4A, or Table 18A.

In some embodiments, the portion of the sense strand is a sense strand chosen from the sense strands of AD-953374 (SEQ ID NO: 813), AD-953504 (SEQ ID NO: 1297), AD-953481 (SEQ ID NO: 1298), AD-953351 (SEQ ID NO: 800), AD-901356 (SEQ ID NO: 261), AD-953344 (SEQ ID NO: 787), AD-901355 (SEQ ID NO: 262), AD-953410 (SEQ ID NO: 845), AD-953363 (SEQ ID NO: 779), AD-953411 (SEQ ID NO: 844), AD-953350 (SEQ ID NO: 784), or AD-953375 (SEQ ID NO: 790). In some embodiments, the portion is a portion of a corresponding chemically modified sequence provided in Tables 2A, 3A, 4A, or Table 18A.

In some embodiments, the portion of the antisense strand is a portion within an antisense strand from a duplex chosen from AD-1020574 (UGAUUAAGGACUGUUCUGUCGAU (SEQ ID NO: 4212)), AD-901094 (UCUGGAUUAAGGACUGUUCUGUC (SEQ ID NO: 4213)), AD-1020575 (UCUGGATUAAGGACUGUUCUGUC (SEQ ID NO: 4214)), AD-901100 (UCCAAUAACAUUAGCACUGUUAA (SEQ ID NO: 4215)), AD-901101 (UACACCAAUAACAUUAGCACUGU (SEQ ID NO: 4216)), AD-901113 (UCGUAUAUAAAACACUUUCUCUU (SEQ ID NO: 4217)), AD-901123 (UAGAAUAGCAAUGUCUAUUUUAU (SEQ ID NO: 4218)), AD-901124 (UCAGAAUAGCAAUGUCUAUUUUA (SEQ ID NO: 4219)), AD-901158 (UACCGUAUAUAAAACACUUUCUC (SEQ ID NO: 4220)), AD-901159 (UAUAAGUACCGUAUAUAAAACAC (SEQ ID NO: 4221)), AD-1020573 (UACACCAAUAACATUAGCACUGU (SEQ ID NO: 4222)), or AD-1023143 (UAGAAUAGCAATGTCTAUUUUAU (SEQ ID NO: 4223)). In some embodiments, the portion is a portion of a corresponding chemically modified sequence provided in Tables 2A, 3A, 4A, or Table 18A.

In some embodiments, the portion of the antisense strand is an antisense strand chosen from the antisense strands of AD-1020574 (UGAUUAAGGACUGUUCUGUCGAU (SEQ ID NO: 4212)), AD-901094 (UCUGGAUUAAGGACUGUUCUGUC (SEQ ID NO: 4213)), AD-1020575 (UCUGGATUAAGGACUGUUCUGUC (SEQ ID NO: 4214)), AD-901100 (UCCAAUAACAUUAGCACUGUUAA (SEQ ID NO: 4215)), AD-901101 (UACACCAAUAACAUUAGCACUGU (SEQ ID NO: 4216)), AD-901113 (UCGUAUAUAAAACACUUUCUCUU (SEQ ID NO: 4217)), AD-901123 (UAGAAUAGCAAUGUCUAUUUUAU (SEQ ID NO: 4218)), AD-901124 (UCAGAAUAGCAAUGUCUAUUUUA (SEQ ID NO: 4219)), AD-901158 (UACCGUAUAUAAAACACUUUCUC (SEQ ID NO: 4220)), AD-901159 (UAUAAGUACCGUAUAUAAAACAC (SEQ ID NO: 4221)), AD-1020573 (UACACCAAUAACATUAGCACUGU (SEQ ID NO: 4222)), or AD-1023143 (UAGAAUAGCAATGTCTAUUUUAU (SEQ ID NO: 4223)). In some embodiments, the portion is a portion of a corresponding chemically modified sequence provided in Tables 2A, 3A, 4A, or Table 18A.

In some embodiments, the portion of the antisense strand is a portion within an antisense strand from a duplex chosen from AD-953374 (SEQ ID NO: 943), AD-953504 (SEQ ID NO: 1427), AD-953481 (SEQ ID NO: 1428), AD-953351 (SEQ ID NO: 930), AD-901356 (SEQ ID NO: 390), AD-953344 (SEQ ID NO: 917), AD-901355 (SEQ ID NO: 391), AD-953410 (SEQ ID NO: 975), AD-953363 (SEQ ID NO: 909), AD-953411 (SEQ ID NO: 974), AD-953350 (SEQ ID NO: 914), or AD-953375 (SEQ ID NO: 920). In some embodiments, the portion is a portion of a corresponding chemically modified sequence provided in Tables 2A, 3A, 4A, or Table 18A.

In some embodiments, the portion of the antisense strand is an antisense strand chosen from the antisense strands of AD-953374 (SEQ ID NO: 943), AD-953504 (SEQ ID NO: 1427), AD-953481 (SEQ ID NO: 1428), AD-953351 (SEQ ID NO: 930), AD-901356 (SEQ ID NO: 390), AD-953344 (SEQ ID NO: 917), AD-901355 (SEQ ID NO: 391), AD-953410 (SEQ ID NO: 975), AD-953363 (SEQ ID NO: 909), AD-953411 (SEQ ID NO: 974), AD-953350 (SEQ ID NO: 914), or AD-953375 (SEQ ID NO: 920). In some embodiments, the portion is a portion of a corresponding chemically modified sequence provided in Tables 2A, 3A, 4A, or Table 18A.

In some embodiments, the sense strand and the antisense strand of the dsRNA agent comprise nucleotide sequences of the paired sense strand and antisense strand of a duplex selected from AD-1020574 (SEQ ID NO: 4200 and 4212), AD-901094 (SEQ ID NO: 4201 and 4213), AD-1020575 (SEQ ID NO: 4202 and 4214), AD-901100 (SEQ ID NO: 4203 and 4215), AD-901101 (SEQ ID NO: 4204 and 4216), AD-901113 (SEQ ID NO: 4205 and 4217), AD-901123 (SEQ ID NO: 4206 and 4218), AD-901124 (SEQ ID NO: 4207 and 4219), AD-901158 (SEQ ID NO: 4208 and 4220), AD-901159 (SEQ ID NO: 4209 and 4221), AD-1020573 (SEQ ID NO: 4210 and 4222), or AD-1023143 (SEQ ID NO: 4211 and 4223). In some embodiments, the sense strand and antisense strand comprises the corresponding chemically modified sense sequence and antisense sequence provided in Tables 2A, 3A, 4A, or Table 18A.

In some embodiments, the sense strand and the antisense strand of the dsRNA agent comprise nucleotide sequences of the paired sense strand and antisense strand of a duplex selected from AD-953374 (SEQ ID NO: 813 and 943), AD-953504 (SEQ ID NO: 1297 and 1427), AD-953481 (SEQ ID NO: 1298 and 1428), AD-953351 (SEQ ID NO: 800 and 930), AD-901356 (SEQ ID NO: 261 and 390), AD-953344 (SEQ ID NO: 787 and 917), AD-901355 (SEQ ID NO: 262 and 391), AD-953410 (SEQ ID NO: 845 and 975), AD-953363 (SEQ ID NO: 779 and 909), AD-953411 (SEQ ID NO: 844 and 974), AD-953350 (SEQ ID NO: 784 and 914), or AD-953375 (SEQ ID NO: 790 and 920). In some embodiments, the sense strand and antisense strand comprises the corresponding chemically modified sense sequence and antisense sequence provided in Tables 2A, 3A, 4A, or Table 18A.

In some embodiments, at least one of the sense strand and the antisense strand is conjugated to one or more lipophilic moieties. In some embodiments, the lipophilic moiety is conjugated to one or more positions in the double stranded region of the dsRNA agent. In some embodiments, the lipophilic moiety is conjugated via a linker or carrier. In some embodiments, lipophilicity of the lipophilic moiety, measured by log Kow, exceeds 0. In some embodiments, In some embodiments, the hydrophobicity of the double-stranded RNAi agent, measured by the unbound fraction in a plasma protein binding assay of the double-stranded RNAi agent, exceeds 0.2. In some embodiments, the plasma protein binding assay is an electrophoretic mobility shift assay using human serum albumin protein.

In some embodiments, the dsRNA agent comprises at least one modified nucleotide. In some embodiments, no more than five of the sense strand nucleotides and not more than five of the nucleotides of the antisense strand are unmodified nucleotides. In some embodiments, all of the nucleotides of the sense strand and all of the nucleotides of the antisense strand comprise a modification.

In some embodiments, at least one of the modified nucleotides is selected from the group consisting of a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a glycol modified nucleotide, and a 2-O—(N-methylacetamide) modified nucleotide; and combinations thereof. In some embodiments, no more than five of the sense strand nucleotides and not more than five of the nucleotides of the antisense strand include modifications other than 2'-O-methyl modified nucleotide, a 2'-fluoro modified nucleotide, a 2'-deoxy-modified nucleotide, unlocked nucleic acids (UNA) or glycerol nucleic acid (GNA).

In some embodiments, the dsRNA comprises a non-nucleotide spacer (wherein optionally the non-nucleotide spacer comprises a C3-C6 alkyl) between two of the contiguous nucleotides of the sense strand or between two of the contiguous nucleotides of the antisense strand.

In some embodiments, each strand is no more than 30 nucleotides in length. In some embodiments, at least one strand comprises a 3' overhang of at least 1 nucleotide. In some embodiments, at least one strand comprises a 3' overhang of at least 2 nucleotides. In some embodiments, at least one strand comprises a 3' overhang of 2 nucleotides.

In some embodiments, the double stranded region is 15-30 nucleotide pairs in length. In some embodiments, the double stranded region is 17-23 nucleotide pairs in length. In some embodiments, the double stranded region is 17-25 nucleotide pairs in length. In some embodiments, the double stranded region is 23-27 nucleotide pairs in length. In some embodiments, the double stranded region is 19-21 nucleotide pairs in length. In some embodiments, the double stranded region is 21-23 nucleotide pairs in length. In some embodiments, each strand has 19-30 nucleotides. In some embodiments, each strand has 19-23 nucleotides. In some embodiments, each strand has 21-23 nucleotides.

In some embodiments, the agent comprises at least one phosphorothioate or methylphosphonate internucleotide linkage. In some embodiments, the phosphorothioate or methylphosphonate internucleotide linkage is at the 3'-terminus of one strand. In some embodiments, the strand is the antisense strand. In some embodiments, the strand is the sense strand.

In some embodiments, the phosphorothioate or methylphosphonate internucleotide linkage is at the 5'-terminus of one strand. In some embodiments, the strand is the antisense strand. In some embodiments, the strand is the sense strand.

In some embodiments, each of the 5'- and 3'-terminus of one strand comprises a phosphorothioate or methylphosphonate internucleotide linkage. In some embodiments, the strand is the antisense strand.

In some embodiments, the base pair at the 1 position of the 5'-end of the antisense strand of the duplex is an AU base pair.

In some embodiments, the sense strand has a total of 21 nucleotides and the antisense strand has a total of 23 nucleotides.

In some embodiments, one or more lipophilic moieties are conjugated to one or more internal positions on at least one strand. In some embodiments, the one or more lipophilic moieties are conjugated to one or more internal positions on at least one strand via a linker or carrier.

In some embodiments, the internal positions include all positions except the terminal two positions from each end of the at least one strand. In some embodiments, the internal positions include all positions except the terminal three positions from each end of the at least one strand. In some embodiments, the internal positions exclude a cleavage site region of the sense strand. In some embodiments, the internal positions include all positions except positions 9-12, counting from the 5'-end of the sense strand. In some embodiments, the internal positions include all positions except positions 11-13, counting from the 3'-end of the sense strand. In some embodiments, the internal positions exclude a cleavage site region of the antisense strand. In some embodiments, the internal positions include all positions except positions 12-14, counting from the 5'-end of the antisense strand. In some embodiments, the internal positions include all positions except positions 11-13 on the sense strand, counting from the 3'-end, and positions 12-14 on the antisense strand, counting from the 5'-end.

In some embodiments, the one or more lipophilic moieties are conjugated to one or more of the internal positions selected from the group consisting of positions 4-8 and 13-18 on the sense strand, and positions 6-10 and 15-18 on the antisense strand, counting from the 5'end of each strand. In some embodiments, the one or more lipophilic moieties are conjugated to one or more of the internal positions selected from the group consisting of positions 5, 6, 7, 15, and 17 on the sense strand, and positions 15 and 17 on the antisense strand, counting from the 5'-end of each strand.

In some embodiments, the positions in the double stranded region exclude a cleavage site region of the sense strand.

In some embodiments, the sense strand is 21 nucleotides in length, the antisense strand is 23 nucleotides in length, and the lipophilic moiety is conjugated to position 21, position 20, position 15, position 1, position 7, position 6, or position 2 of the sense strand or position 16 of the antisense strand. In some embodiments, the lipophilic moiety is conjugated to position 21, position 20, position 15, position 1, or position 7 of the sense strand. In some embodiments, the lipophilic moiety is conjugated to position 21, position 20, or position 15 of the sense strand. In some embodiments, the lipophilic moiety is conjugated to position 20 or position 15 of the sense strand. In some embodiments, the lipophilic moiety is conjugated to position 16 of the antisense strand. In some embodiments, the lipophilic moiety is conjugated to position 6, counting from the 5'-end of the sense strand.

In some embodiments, the lipophilic moiety is an aliphatic, alicyclic, or polyalicyclic compound. In some embodiments, the lipophilic moiety is selected from the group consisting of lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine. In some embodiments, the lipophilic moiety contains a saturated or unsaturated C4-C30 hydrocarbon chain, and an optional functional group selected from the group consisting of hydroxyl, amine, carboxylic acid, sulfonate, phosphate, thiol, azide, and alkyne. In some embodiments, the lipophilic moiety contains a saturated or unsaturated C6-C18 hydrocarbon chain. In some embodiments, the lipophilic moiety contains a saturated or unsaturated C16 hydrocarbon chain.

In some embodiments, the lipophilic moiety is conjugated via a carrier that replaces one or more nucleotide(s) in the internal position(s) or the double stranded region. In some embodiments, the carrier is a cyclic group selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl; or is an acyclic moiety based on a serinol backbone or a diethanolamine backbone.

In some embodiments, the lipophilic moiety is conjugated to the double-stranded iRNA agent via a linker containing an ether, thioether, urea, carbonate, amine, amide, maleimide-thioether, disulfide, phosphodiester, sulfonamide linkage, a product of a click reaction, or carbamate.

In some embodiments, the lipophilic moiety is conjugated to a nucleobase, sugar moiety, or internucleosidic linkage.

In some embodiments, the lipophilic moiety or targeting ligand is conjugated via a bio-cleavable linker selected from the group consisting of DNA, RNA, disulfide, amide, functionalized monosaccharides or oligosaccharides of galactosamine, glucosamine, glucose, galactose, mannose, and combinations thereof.

In some embodiments, the 3' end of the sense strand is protected via an end cap which is a cyclic group having an amine, said cyclic group being selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl.

In some embodiments, the dsRNA agent further comprises a targeting ligand, e.g., a ligand that targets an ocular tissue or a liver tissue. In some embodiments, the ocular tissue is a retinal pigment epithelium (RPE) or choroid tissue, e.g., a choroid vessel.

In some embodiments, the ligand is conjugated to the sense strand. In some embodiments, the ligand is conjugated to the 3' end or the 5' end of the sense strand. In some embodiments, the ligand is conjugated to the 3' end of the sense strand.

In some embodiments, the ligand comprises N-acetylgalactosamine (GalNAc). In some embodiments, the targeting ligand comprises one or more GalNAc conjugates or one or more GalNAc derivatives. In some embodiments, the ligand is one or more GalNAc conjugates or one or more GalNAc derivatives are attached through a monovalent linker, or a bivalent, trivalent, or tetravalent branched linker. In some embodiments, the ligand is

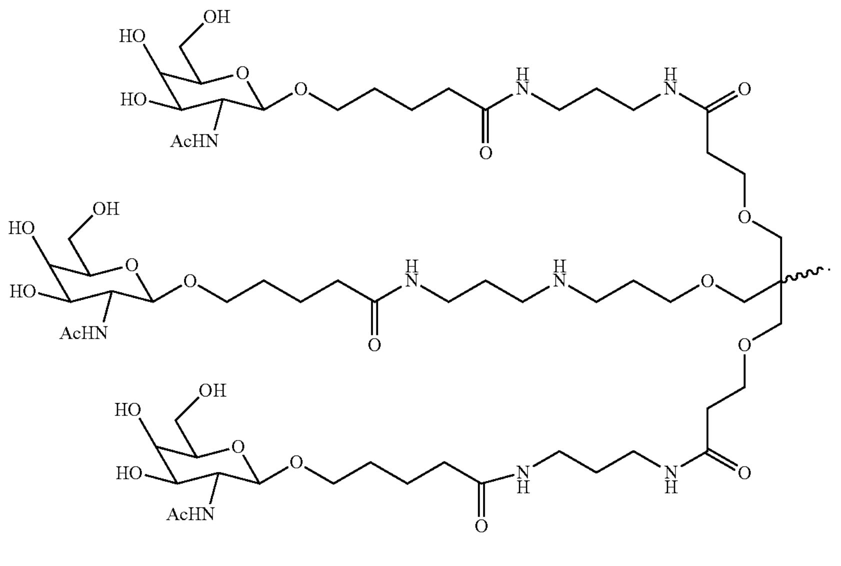 [SMILES: CC(=O)NC1C(OCCCCC(=O)NCCCNCCCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In some embodiments, the dsRNA agent is conjugated to the ligand as shown in the following schematic

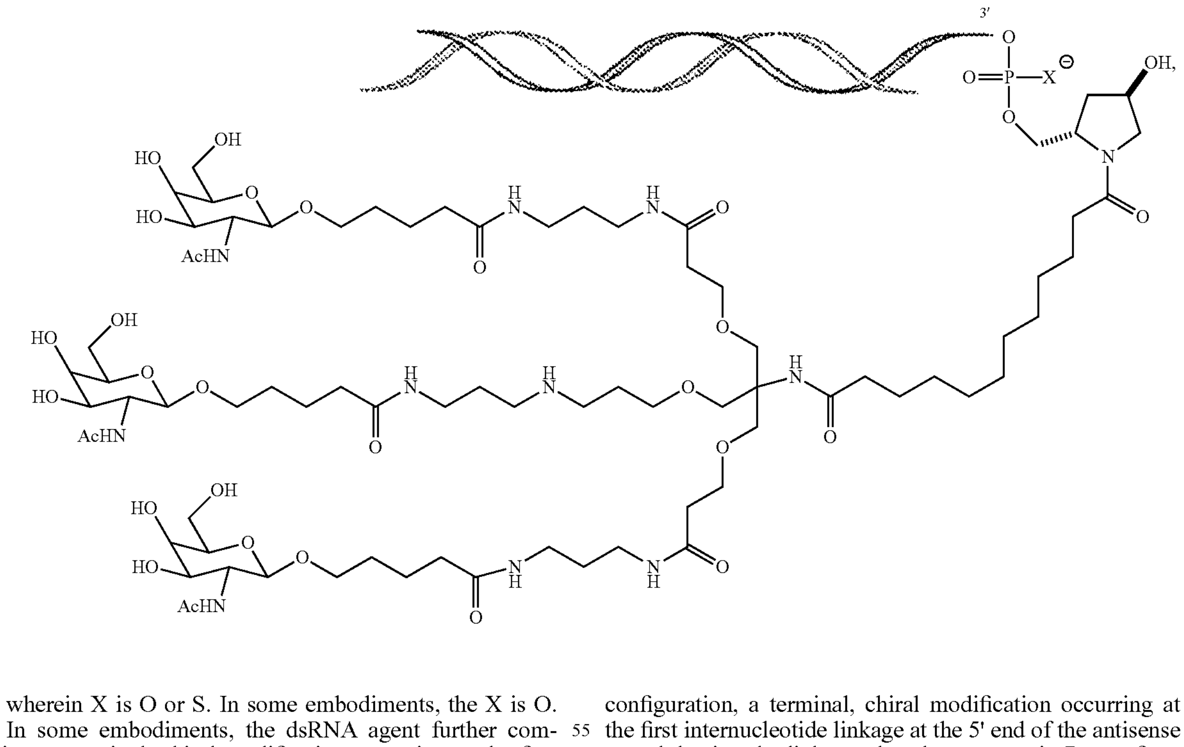

wherein X is O or S. In some embodiments, the X is O.

In some embodiments, the dsRNA agent further comprises a terminal, chiral modification occurring at the first internucleotide linkage at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp configuration or Sp configuration.

In some embodiments, the dsRNA agent further comprises a terminal, chiral modification occurring at the first and second internucleotide linkages at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In some embodiments, the dsRNA agent further comprises a terminal, chiral modification occurring at the first, second and third internucleotide linkages at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In some embodiments, the dsRNA agent further comprises a terminal, chiral modification occurring at the first, and second internucleotide linkages at the 3' end of the antisense strand, having the linkage phosphorus atom in Sp configuration, a terminal, chiral modification occurring at the third internucleotide linkages at the 3' end of the antisense strand, having the linkage phosphorus atom in Rp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In some embodiments, the dsRNA agent further comprises a terminal, chiral modification occurring at the first, and second internucleotide linkages at the 3' end of the antisense strand, having the linkage phosphorus atom in Sp configuration, a terminal, chiral modification occurring at the first, and second internucleotide linkages at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In some embodiments, the dsRNA agent further comprises a phosphate or phosphate mimic at the 5'-end of the antisense strand. In some embodiments, the phosphate mimic is a 5'-vinyl phosphonate (VP).

In some embodiments, a cell described herein, e.g., a human cell, was produced by a process comprising contacting a human cell with the dsRNA agent described herein.

In some embodiments, a pharmaceutical composition described herein comprises the dsRNA agent and a lipid formulation.

In some embodiments (e.g., embodiments of the methods described herein), the cell is within a subject. In some embodiments, the subject is a human. In some embodiments, the level of VEGF-A mRNA is inhibited by at least 50%. In some embodiments, the level of VEGF-A protein is inhibited by at least 50%. In some embodiments, the expression of VEGF-A is inhibited by at least 50%. In some embodiments, inhibiting expression of VEGF-A decreases the VEGF-A protein level in a biological sample (e.g., an aqueous ocular fluid sample) from the subject by at least 30%, 40%, 50%, 60%, 70%, 80%, 90%, or 95%. In some embodiments, inhibiting expression of VEGF-A gene decreases the VEGF-A mRNA level in a biological sample (e.g., an aqueous ocular fluid sample) from the subject by at least 30%, 40%, 50%, 60%, 70%, 80%, 90%, or 95%.

In some embodiments, the subject has been diagnosed with a VEGF-A-associated disorder. In some embodiments, the subject meets at least one diagnostic criterion for a VEGF-A-associated disorder. In some embodiments, the VEGF-A associated disorder is wet age-related macular degeneration (wet AMD), diabetic retinopathy (DR), diabetic macular edema (DME), retinal vein occlusion (RVO), macular edema following retinal vein occlusion (MEfRVO), retinopathy of prematurity (ROP), or myopic choroidal neovascularization (mCNV). In some embodiments, the VEGF-A associated disorder is macular edema, e.g., diabetic macular edema.

In some embodiments, the ocular cell or tissue is RPE, a retinal cell, an astrocyte, a pericyte, a Müller cell, a ganglion cell, an endothelial cell, a photoreceptor cell, a retinal blood vessel (e.g., including endothelial cells and vascular smooth muscle cells), or choroid tissue, e.g., a choroid vessel.

In some embodiments, the VEGF-A-associated disorder is an angiogenic ocular disorder. In some embodiments, the angiogenic ocular disorder is caused by or associated with the growth or proliferation of blood vessels. In some embodiments, the angiogenic ocular disorder is caused by or associated with ocular neovascularization. In some embodiments, the angiogenic ocular disorder is AMD, DR, DME, RVO, MEfRVO, ROP, or mCNV.

In some embodiments, treating comprises amelioration of at least one sign or symptom of the disorder. In some embodiments, the at least one sign or symptom includes a measure of one or more of angiogenesis, choroidal neovascularization, ocular inflammation, visual acuity, or presence, level, or activity of VEGF-A (e.g., VEGF-A gene, VEGF-A mRNA, or VEGF-A protein).

In some embodiments, a level of the VEGF-A that is higher than a reference level is indicative that the subject has an angiogenic ocular disorder. In some embodiments, treating comprises prevention of progression of the disorder. In some embodiments, the treating comprises one or more of (a) inhibiting angiogenesis; (b) inhibiting or reducing the expression or activity of VEGF-A; (c) inhibiting choroidal neovascularization; (d) inhibiting growth of new blood vessels in the choriocapillaris; (e) reducing retinal thickness; (f) increasing visual acuity; or (g) reducing intraocular inflammation.

In some embodiments, the treating results in at least a 30% mean reduction from baseline of VEGF-A mRNA in the retina, RPE, a retinal blood vessel (e.g., including endothelial cells and vascular smooth muscle cells), or choroid tissue, e.g., a choroid vessel. In some embodiments, the treating results in at least a 60% mean reduction from baseline of VEGF-A mRNA in the retina, RPE, a retinal blood vessel (e.g., including endothelial cells and vascular smooth muscle cells), or choroid tissue, e.g., a choroid vessel. In some embodiments, the treating results in at least a 90% mean reduction from baseline of VEGF-A mRNA in the retina, RPE, a retinal blood vessel (e.g., including endothelial cells and vascular smooth muscle cells), or choroid tissue, e.g., a choroid vessel.

In some embodiments, after treatment the subject experiences at least an 8-week duration of knockdown following a single dose of dsRNA as assessed by VEGF-A protein in the retina. In some embodiments, treating results in at least a 12-week duration of knockdown following a single dose of dsRNA as assessed by VEGF-A protein in the retina. In some embodiments, treating results in at least a 16-week duration of knockdown following a single dose of dsRNA as assessed by VEGF-A protein in the retina.

In some embodiments, the subject is human.

In some embodiments, the dsRNA agent is administered at a dose of about 0.01 mg/kg to about 50 mg/kg.

In some embodiments, the dsRNA agent is administered to the subject intraocularly. In some embodiments, the intraocular administration comprises intravitreal administration, e.g., intravitreal injection; transscleral administration, e.g., transscleral injection; subconjunctival administration, e.g., subconjunctival injection; retrobulbar administration, e.g., retrobulbar injection; intracameral administration, e.g., intracameral injection, or subretinal administration, e.g., subretinal injection.

In some embodiments, the dsRNA agent is administered to the subject intravenously. In some embodiments, the dsRNA agent is administered to the subject topically.

In some embodiments, a method described herein further comprises measuring a level of VEGF-A (e.g., VEGF-A gene, VEGF-A mRNA, or VEGF-A protein) in the subject. In some embodiments, measuring the level of VEGF-A in the subject comprises measuring the level of VEGF-A protein in a biological sample from the subject (e.g., an aqueous ocular fluid sample). In some embodiments, a method described herein further comprises performing a blood test, an imaging test, or an aqueous ocular fluid biopsy (e.g., an aqueous humor tap).

In some embodiments, a method described herein further measuring level of VEGF-A (e.g., VEGF-A gene, VEGF-A mRNA, or VEGF-A protein) in the subject is performed prior to treatment with the dsRNA agent or the pharmaceutical composition. In some embodiments, upon determination that a subject has a level of VEGF-A that is greater than a reference level, the dsRNA agent or the pharmaceutical composition is administered to the subject. In some embodiments, measuring level of VEGF-A in the subject is performed after treatment with the dsRNA agent or the pharmaceutical composition.

In some embodiments, a method described herein further comprises treating the subject with a therapy suitable for treatment or prevention of a VEGF-A-associated disorder, e.g., wherein the therapy comprises photodynamic therapy, photocoagulation therapy, or vitrectomy. In some embodiments, a method described herein further comprises administering to the subject an additional agent suitable for treatment or prevention of a VEGF-A-associated disorder. In some embodiments, the additional agent comprises a steroid, a non-steroidal anti-inflammatory agent, or an anti-VEGF-A agent.

In some embodiments, the anti-VEGF-A agent comprises a fusion protein or an anti-VEGF-A antibody or antigen-binding fragment thereof (e.g., an anti-VEGF-A antibody molecule).

All publications, patent applications, patents, and other references mentioned herein are incorporated by reference in their entirety.

The details of various embodiments of the disclosure are set forth in the description below. Other features, objects, and advantages of the disclosure will be apparent from the description and the drawings, and from the claims.

Figure 1A:
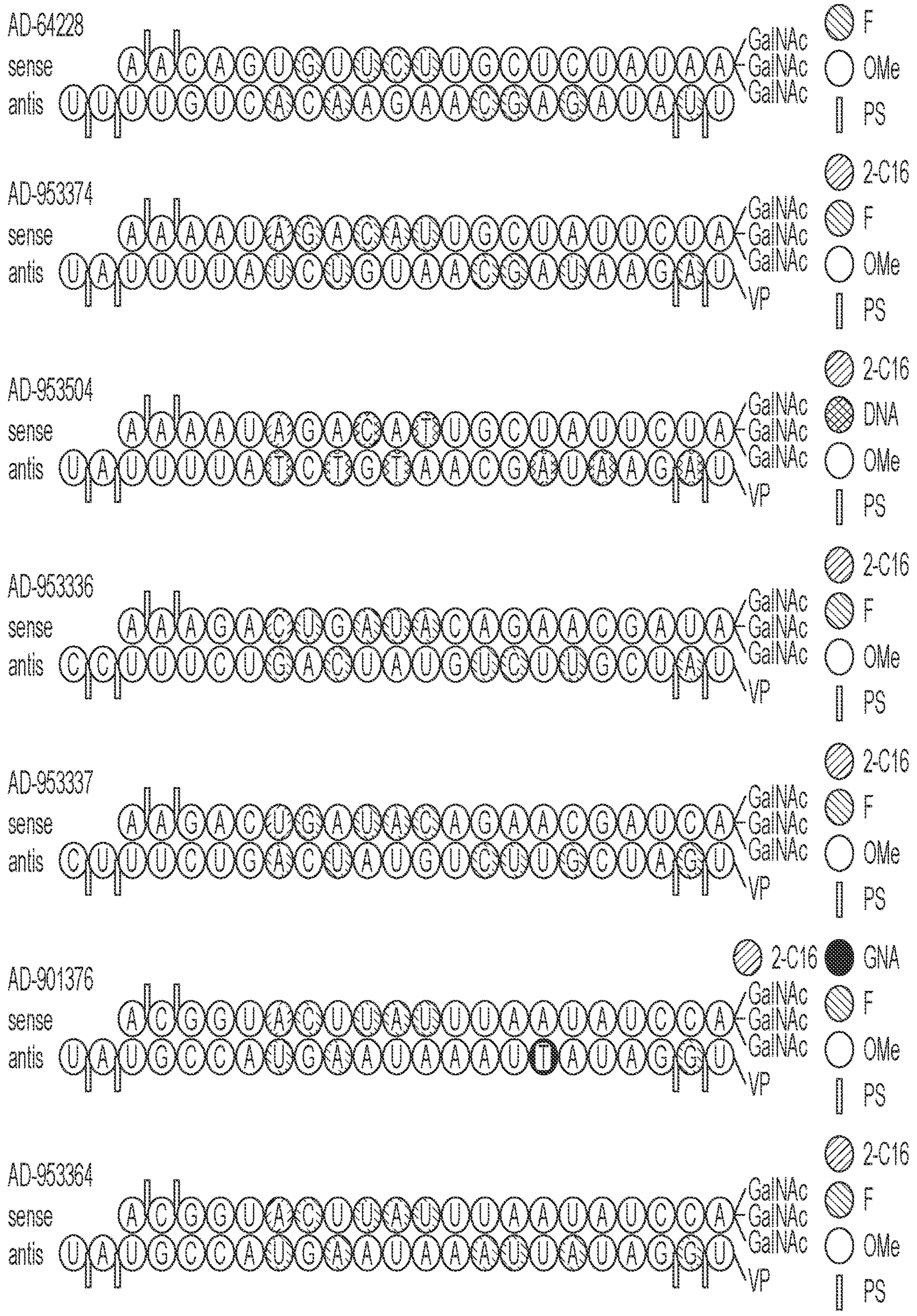
FIG. 1A depicts the sequences and chemistry of the exemplary VEGF-A siRNAs including AD-64228 (SEQ ID NO: 4162 and 4163), AD-953374 (SEQ ID NO: 553 and 683), AD-953504 (SEQ ID NO: 1037 and 1167), AD-953336 (SEQ ID NO: 518 and 648), AD-953337 (SEQ ID NO: 522 and 652), AD-901376 (SEQ ID NO: 4157 and 131), AD-953364 (SEQ ID NO: 567 and 697).

DETAILED DESCRIPTION iRNA directs the sequence-specific degradation of mRNA through a process known as RNA interference (RNAi). Described herein are iRNAs and methods of using them for modulating (e.g., inhibiting) the expression of VEGF-A. Also provided are compositions and methods for treatment of disorders related to VEGF-A expression, such as an angiogenic ocular disorder (e.g., wet age-related macular degeneration (wet AMD), diabetic retinopathy (DR), diabetic macular edema (DME), retinal vein occlusion (RVO), macular edema following retinal vein occlusion (MEfRVO), retinopathy of prematurity (ROP), or myopic choroidal neovascularization (mCNV)).

Human VEGF-A is a dimeric glycoprotein of approximately 40 kDa and is a potent endothelial cell mitogen with a role in proliferation, migration, and tube formation leading to angiogenic growth of new blood vessels. VEGF-A is typically expressed and secreted by a variety of tissues including the retinal pigmented epithelium (RPE), retinal tissues, astrocytes, Müller cells, photoreceptor cells, endothelial cells (e.g., vascular endothelial cells), retinal blood vessels (e.g., including endothelial cells and vascular smooth muscle cells), choroid tissue, e.g., a choroid vessel, and ganglion cells. Several angiogenic ocular disorders are associated with pathological angiogenesis, including wet AMD, DR, DME, RVO, MEfRVO, ROP, and mCNV. Without wishing to be bound by theory, VEGF-A may exacerbate the pathogenesis of angiogenic ocular disorders, e.g., by increasing vascular permeability and promoting neovascularization.

The following description discloses how to make and use compositions containing iRNAs to modulate (e.g., inhibit) the expression of VEGF-A, as well as compositions and methods for treating disorders related to expression of VEGF-A.

In some aspects, pharmaceutical compositions containing VEGF-A iRNA and a pharmaceutically acceptable carrier, methods of using the compositions to inhibit expression of VEGF-A, and methods of using the pharmaceutical compositions to treat disorders related to expression of VEGF-A (e.g., angiogenic ocular disorders) are featured herein.

I. Definitions

For convenience, the meaning of certain terms and phrases used in the specification, examples, and appended claims, are provided below. If there is an apparent discrepancy between the usage of a term in other parts of this specification and its definition provided in this section, the definition in this section shall prevail.

The term "about" when referring to a number or a numerical range means that the number or numerical range referred to is an approximation within experimental variability (or within statistical experimental error), and thus the number or numerical range may vary from, for example, between 1% and 15% of the stated number or numerical range.

The term "at least" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 17 nucleotides of a 20-nucleotide nucleic acid molecule" means that 17, 18, 19, or 20 nucleotides have the indicated property. When at least is present before a series of numbers or a range, it is understood that "at least" can modify each of the numbers in the series or range.

As used herein, "no more than" or "less than" is understood as the value adjacent to the phrase and logical lower values or integers, as logical from context, to zero. For example, a duplex with mismatches to a target site of "no more than 2 nucleotides" has a 2, 1, or 0 mismatches. When "no more than" is present before a series of numbers or a range, it is understood that "no more than" can modify each of the numbers in the series or range.

As used herein, "up to" as in "up to 10" is understood as up to and including 10, i.e., 0, 1, 2, 3, 4, 5, 6, 7, 8, 9, or 10.

Ranges provided herein are understood to include all individual integer values and all subranges within the ranges.

The terms "activate," "enhance," "up-regulate the expression of," "increase the expression of," and the like, in so far as they refer to a VEGF-A gene, herein refer to the at least partial activation of the expression of a VEGF-A gene, as manifested by an increase in the amount of VEGF-A mRNA, which may be isolated from or detected in a first cell or group of cells in which a VEGF-A gene is transcribed and which has or have been treated such that the expression of a VEGF-A gene is increased, as compared to a second cell or group of cells substantially identical to the first cell or group of cells but which has or have not been so treated (control cells).

In some embodiments, expression of a VEGF-A gene is activated by at least about 10%, 15%, 20%, 25%, 30%, 35%, 40%, 45%, or 50% by administration of an iRNA as described herein. In some embodiments, a VEGF-A gene is activated by at least about 60%, 70%, or 80% by administration of an iRNA featured in the disclosure. In some embodiments, expression of a VEGF-A gene is activated by at least about 85%, 90%, or 95% or more by administration of an iRNA as described herein. In some embodiments, the VEGF-A gene expression is increased by at least 1-fold, at least 2-fold, at least 5-fold, at least 10-fold, at least 50-fold, at least 100-fold, at least 500-fold, at least 1000-fold or more in cells treated with an iRNA as described herein compared to the expression in an untreated cell. Activation of expression by small dsRNAs is described, for example, in Li et al., 2006 *Proc. Natl. Acad. Sci. U.S.A.* 103:17337-42, and in US2007/0111963 and US2005/226848, each of which is incorporated herein by reference.

The terms "silence," "inhibit expression of," "down-regulate expression of," "suppress expression of," and the like, in so far as they refer to VEGF-A, herein refer to the at least partial suppression of the expression of VEGF-A, as assessed, e.g., based on VEGF-A mRNA expression, VEGF-A protein expression, or another parameter functionally linked to VEGF-A expression. For example, inhibition of VEGF-A expression may be manifested by a reduction of the amount of VEGF-A mRNA which may be isolated from or detected in a first cell or group of cells in which VEGF-A is transcribed and which has or have been treated such that the expression of VEGF-A is inhibited, as compared to a control. The control may be a second cell or group of cells substantially identical to the first cell or group of cells, except that the second cell or group of cells have not been so treated (control cells). The degree of inhibition is usually expressed as a percentage of a control level, e.g., $$\frac{(\text{mRNA in control cells}) - (\text{mRNA in treated cells})}{(\text{mRNA in control cells})} \cdot 100\%$$

Alternatively, the degree of inhibition may be given in terms of a reduction of a parameter that is functionally linked to VEGF-A expression, e.g., the amount of protein encoded by a VEGF-A gene. The reduction of a parameter functionally linked to VEGF-A expression may similarly be expressed as a percentage of a control level. In principle, VEGF-A silencing may be determined in any cell expressing VEGF-A, either constitutively or by genomic engineering, and by any appropriate assay.

For example, in certain instances, expression of VEGF-A is suppressed by at least about 10%, 15%, 20%, 25%, 30%, 35%, 40%, 45%, or 50% by administration of an iRNA disclosed herein. In some embodiments, VEGF-A is suppressed by at least about 60%, 65%, 70%, 75%, or 80% by administration of an iRNA disclosed herein. In some embodiments, VEGF-A is suppressed by at least about 85%, 90%, 95%, 98%, 99%, or more by administration of an iRNA as described herein.

The term "antisense strand" or "guide strand" refers to the strand of an iRNA, e.g., a dsRNA, which includes a region that is substantially complementary to a target sequence.

As used herein, the term "region of complementarity" refers to the region on the antisense strand that is substantially complementary to a sequence, for example a target sequence, as defined herein. Where the region of complementarity is not fully complementary to the target sequence, the mismatches may be in the internal or terminal regions of the molecule. In some embodiments, the region of complementarity comprises 0, 1, or 2 mismatches.

The term "sense strand" or "passenger strand" as used herein, refers to the strand of an iRNA that includes a region that is substantially complementary to a region of the antisense strand as that term is defined herein.

The terms "blunt" or "blunt ended" as used herein in reference to a dsRNA mean that there are no unpaired nucleotides or nucleotide analogs at a given terminal end of a dsRNA, i.e., no nucleotide overhang. One or both ends of a dsRNA can be blunt. Where both ends of a dsRNA are blunt, the dsRNA is said to be blunt ended. To be clear, a "blunt ended" dsRNA is a dsRNA that is blunt at both ends, i.e., no nucleotide overhang at either end of the molecule. Most often such a molecule will be double-stranded over its entire length.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they may form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes described herein.

Complementary sequences, as used herein, may also include, or be formed entirely from, non-Watson-Crick base pairs and/or base pairs formed from non-natural and modified nucleotides, in as far as the above requirements with respect to their ability to hybridize are fulfilled. Such non-Watson-Crick base pairs includes, but are not limited to, G:U Wobble or Hoogstein base pairing.

The terms "complementary," "fully complementary" and "substantially complementary" herein may be used with respect to the base matching between the sense strand and the antisense strand of a dsRNA, or between the antisense strand of an iRNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding a VEGF-A protein). For example, a polynucleotide is complementary to at least a part of a VEGF-A mRNA if the sequence is substantially complementary to a non-interrupted portion of an mRNA encoding VEGF-A. The term "complementarity" refers to the capacity for pairing between nucleobases of a first nucleic acid and a second nucleic acid.

As used herein, the term "region of complementarity" refers to the region of one nucleotide sequence agent that is substantially complementary to another sequence, e.g., the region of a sense sequence and corresponding antisense sequence of a dsRNA, or the antisense strand of an iRNA and a target sequence, e.g., a VEGF-A nucleotide sequence, as defined herein. Where the region of complementarity is not fully complementary to the target sequence, the mismatches can be in the internal or terminal regions of the antisense strand of the iRNA. Generally, the most tolerated mismatches are in the terminal regions, e.g., within 5, 4, 3, or 2 nucleotides of the 5'- or 3'-terminus of the iRNA agent.

"Contacting," as used herein, includes directly contacting a cell, as well as indirectly contacting a cell. For example, a cell within a subject may be contacted when a composition comprising an iRNA is administered (e.g., intraocularly, topically, or intravenously) to the subject.

"Introducing into a cell," when referring to an iRNA, means facilitating or effecting uptake or absorption into the cell. Absorption or uptake of an iRNA can occur through unaided diffusive or active cellular processes, or by auxiliary agents or devices. The meaning of this term is not limited to cells in vitro; an iRNA may also be "introduced into a cell," wherein the cell is part of a living organism. In such an instance, introduction into the cell will include the delivery to the organism. For example, for in vivo delivery, iRNA can be injected into a tissue site or administered systemically. In vivo delivery can also be by a β-glucan delivery system, such as those described in U.S. Pat. Nos. 5,032,401 and 5,607,677, and U.S. Publication No. 2005/0281781, which are hereby incorporated by reference in their entirety. In vitro introduction into a cell includes methods known in the art such as electroporation and lipofection. Further approaches are described herein below or known in the art.

As used herein, a "disorder related to VEGF-A expression," a "disease related to VEGF-A expression," a "pathological process related to VEGF-A expression," "a VEGF-A-associated disorder," "a VEGF-A-associated disease," or the like includes any condition, disorder, or disease in which VEGF-A expression is altered (e.g., decreased or increased relative to a reference level, e.g., a level characteristic of a non-diseased subject). In some embodiments, VEGF-A expression is decreased. In some embodiments, VEGF-A expression is increased. In some embodiments, the decrease or increase in VEGF-A expression is detectable in a tissue sample from the subject (e.g., in an aqueous ocular fluid sample). The decrease or increase may be assessed relative the level observed in the same individual prior to the development of the disorder or relative to other individual(s) who do not have the disorder. The decrease or increase may be limited to a particular organ, tissue, or region of the body (e.g., the eye). VEGF-A-associated disorders include, but are not limited to, angiogenic ocular disorders.

The term "angiogenic ocular disorder," as used herein, means any disease of the eye that is caused by or associated with the growth or proliferation of blood vessels or by blood vessel leakage. Non-limiting examples of angiogenic ocular disorders that are treatable using methods provided herein include age-related macular degeneration (e.g., wet AMD, exudative AMD, etc.), retinal vein occlusion (RVO), central retinal vein occlusion (CRVO; e.g., macular edema following RVO (MEfRVO)), branch retinal vein occlusion (BRVO), retinopathy of prematurity (ROP), diabetic macular edema (DME), choroidal neovascularization (CNV; e.g., myopic CNV), iris neovascularization, neovascular glaucoma, post-surgical fibrosis in glaucoma, proliferative retinopathy, proliferative vitreoretinopathy (PVR), optic disc neovascularization, corneal neovascularization, retinal neovascularization, vitreal neovascularization, pannus, pterygium, vascular retinopathy, von Hippel-Lindau disease, histoplasmosis, and diabetic retinopathies.

The term "double-stranded RNA," "dsRNA," or "siRNA" as used herein, refers to an iRNA that includes an RNA molecule or complex of molecules having a hybridized duplex region that comprises two anti-parallel and substantially complementary nucleic acid strands, which will be referred to as having "sense" and "antisense" orientations with respect to a target RNA. The duplex region can be of any length that permits specific degradation of a desired target RNA, e.g., through a RISC pathway, but will typically range from 9 to 36 base pairs in length, e.g., 15-30 base pairs in length. Considering a duplex between 9 and 36 base pairs, the duplex can be any length in this range, for example, 9, 10, 11, 12, 13, 14, 15, 16, 17, 18, 19, 20, 21, 22, 23, 24, 25, 26, 27, 28, 29, 30, 31, 32, 33, 34, 35, or 36 and any sub-range therein between, including, but not limited to 15-30 base pairs, 15-26 base pairs, 15-23 base pairs, 15-22 base pairs, 15-21 base pairs, 15-20 base pairs, 15-19 base pairs, 15-18 base pairs, 15-17 base pairs, 18-30 base pairs, 18-26 base pairs, 18-23 base pairs, 18-22 base pairs, 18-21 base pairs, 18-20 base pairs, 19-30 base pairs, 19-26 base pairs, 19-23 base pairs, 19-22 base pairs, 19-21 base pairs, 19-20 base pairs, 20-30 base pairs, 20-26 base pairs, 20-25 base pairs, 20-24 base pairs, 20-23 base pairs, 20-22 base pairs, 20-21 base pairs, 21-30 base pairs, 21-26 base pairs, 21-25 base pairs, 21-24 base pairs, 21-23 base pairs, or 21-22 base pairs. dsRNAs generated in the cell by processing with Dicer and similar enzymes are generally in the range of 19-22 base pairs in length. One strand of the duplex region of a dsDNA comprises a sequence that is substantially complementary to a region of a target RNA. The two strands forming the duplex structure can be from a single RNA molecule having at least one self-complementary region, or can be formed from two or more separate RNA molecules. Where the duplex region is formed from two strands of a single molecule, the molecule can have a duplex region separated by a single stranded chain of nucleotides (herein referred to as a "hairpin loop") between the 3'-end of one strand and the 5'-end of the respective other strand forming the duplex structure. The hairpin loop can comprise at least one unpaired nucleotide; in some embodiments the hairpin loop can comprise at least 3, at least 4, at least 5, at least 6, at least 7, at least 8, at least 9, at least 10, at least 20, at least 23 or more unpaired nucleotides. Where the two substantially complementary strands of a dsRNA are comprised by separate RNA molecules, those molecules need not, but can be covalently connected. In some embodiments, the two strands are connected covalently by means other than a hairpin loop, and the connecting structure is a linker.

In some embodiments, the iRNA agent may be a "single-stranded siRNA" that is introduced into a cell or organism to inhibit a target mRNA. In some embodiments, single-stranded RNAi agents can bind to the RISC endonuclease Argonaute 2, which then cleaves the target mRNA. The single-stranded siRNAs are generally 15-30 nucleotides and are optionally chemically modified. The design and testing of single-stranded siRNAs are described in U.S. Pat. No. 8,101,348 and in Lima et al., (2012) *Cell* 150: 883-894, the entire contents of each of which are hereby incorporated herein by reference. Any of the antisense nucleotide sequences described herein (e.g., sequences provided in Tables 2A, 2B, 3A, 3B, 4A, 4B, 5A, 5B, 8A, 8B, 10A, 10B, 12, 13, 14, 18A or 18B) may be used as a single-stranded siRNA as described herein and optionally as chemically modified, e.g., as described herein, e.g., by the methods described in Lima et al., (2012) *Cell* 150:883-894.

In some embodiments, an RNA interference agent includes a single stranded RNA that interacts with a target RNA sequence to direct the cleavage of the target RNA. Without wishing to be bound by theory, long double stranded RNA introduced into cells is broken down into siRNA by a Type III endonuclease known as Dicer (Sharp et al., *Genes Dev.* 2001, 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107: 309). Upon binding to the appropriate target mRNA, one or more endonucleases within the RISC cleaves the target to induce silencing (Elbashir, et al., (2001) *Genes Dev.* 15:188).

Thus, in some embodiments, the disclosure relates to a single stranded RNA that promotes the formation of a RISC complex to effect silencing of the target gene.

"G," "C," "A," "T" and "U" each generally stand for a nucleotide that contains guanine, cytosine, adenine, thymidine and uracil as a base, respectively. However, it will be understood that the terms "deoxyribonucleotide," "ribonucleotide," or "nucleotide" can also refer to a modified nucleotide, as further detailed below, or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of dsRNA featured in the disclosure by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the disclosure.

As used herein, the term "iRNA," "RNAi", "iRNA agent," or "RNAi agent" or "RNAi molecule" refers to an agent that contains RNA as that term is defined herein, and which mediates the targeted cleavage of an RNA transcript, e.g., via an RNA-induced silencing complex (RISC) pathway. In some embodiments, an iRNA as described herein effects inhibition of VEGF-A expression, e.g., in a cell or mammal. Inhibition of VEGF-A expression may be assessed based on a reduction in the level of VEGF-A mRNA or a reduction in the level of the VEGF-A protein.

The term "linker" or "linking group" means an organic moiety that connects two parts of a compound, e.g., covalently attaches two parts of a compound.

The term "lipophile" or "lipophilic moiety" broadly refers to any compound or chemical moiety having an affinity for lipids. One way to characterize the lipophilicity of the lipophilic moiety is by the octanol-water partition coefficient, log $K_{ow}$, where $K_{ow}$ is the ratio of a chemical's concentration in the octanol-phase to its concentration in the aqueous phase of a two-phase system at equilibrium. The octanol-water partition coefficient is a laboratory-measured property of a substance. However, it may also be predicted by using coefficients attributed to the structural components of a chemical which are calculated using first-principle or empirical methods (see, for example, Tetko et al., *J. Chem. Inf. Comput. Sci.* 41:1407-21 (2001), which is incorporated herein by reference in its entirety). It provides a thermodynamic measure of the tendency of the substance to prefer a non-aqueous or oily milieu rather than water (i.e. its hydrophilic/lipophilic balance). In principle, a chemical substance is lipophilic in character when its log $K_{ow}$ exceeds 0. Typically, the lipophilic moiety possesses a log $K_{ow}$ exceeding 1, exceeding 1.5, exceeding 2, exceeding 3, exceeding 4, exceeding 5, or exceeding 10. For instance, the log $K_{ow}$ of 6-amino hexanol, for instance, is predicted to be approximately 0.7. Using the same method, the log $K_{ow}$ of cholesteryl N-(hexan-6-ol) carbamate is predicted to be 10.7.

The lipophilicity of a molecule can change with respect to the functional group it carries. For instance, adding a hydroxyl group or amine group to the end of a lipophilic moiety can increase or decrease the partition coefficient (e.g., log $K_{ow}$) value of the lipophilic moiety.

Alternatively, the hydrophobicity of the double-stranded RNAi agent, conjugated to one or more lipophilic moieties, can be measured by its protein binding characteristics. For instance, in certain embodiments, the unbound fraction in the plasma protein binding assay of the double-stranded RNAi agent could be determined to positively correlate to the relative hydrophobicity of the double-stranded RNAi agent, which could then positively correlate to the silencing activity of the double-stranded RNAi agent.

In some embodiments, the plasma protein binding assay determined is an electrophoretic mobility shift assay (EMSA) using human serum albumin protein. An exemplary protocol of this binding assay is illustrated in detail in, e.g., PCT/US2019/031170. The hydrophobicity of the double-stranded RNAi agent, measured by fraction of unbound siRNA in the binding assay, exceeds 0.15, exceeds 0.2, exceeds 0.25, exceeds 0.3, exceeds 0.35, exceeds 0.4, exceeds 0.45, or exceeds 0.5 for an enhanced in vivo delivery of siRNA.

Accordingly, conjugating the lipophilic moieties to the internal position(s) of the double-stranded RNAi agent provides optimal hydrophobicity for the enhanced in vivo delivery of siRNA.

The term "lipid nanoparticle" or "LNP" is a vesicle comprising a lipid layer encapsulating a pharmaceutically active molecule, such as a nucleic acid molecule, e.g., a RNAi agent or a plasmid from which a RNAi agent is transcribed. LNPs are described in, for example, U.S. Pat. Nos. 6,858,225, 6,815,432, 8,158,601, and 8,058,069, the entire contents of which are hereby incorporated herein by reference.

As used herein, the term "modulate the expression of," refers to an at least partial "inhibition" or partial "activation" of a gene (e.g., VEGF-A gene) expression in a cell treated with an iRNA composition as described herein compared to the expression of the corresponding gene in a control cell. A control cell includes an untreated cell, or a cell treated with a non-targeting control iRNA.

The skilled artisan will recognize that the term "RNA molecule" or "ribonucleic acid molecule" encompasses not only RNA molecules as expressed or found in nature, but also analogs and derivatives of RNA comprising one or more ribonucleotide/ribonucleoside analogs or derivatives as described herein or as known in the art. Strictly speaking, a "ribonucleoside" includes a nucleoside base and a ribose sugar, and a "ribonucleotide" is a ribonucleoside with one, two or three phosphate moieties or analogs thereof (e.g., phosphorothioate). However, the terms "ribonucleoside" and "ribonucleotide" can be considered to be equivalent as used herein. The RNA can be modified in the nucleobase structure, in the ribose structure, or in the ribose-phosphate backbone structure, e.g., as described herein below. However, the molecules comprising ribonucleoside analogs or derivatives must retain the ability to form a duplex. As non-limiting examples, an RNA molecule can also include at least one modified ribonucleoside including but not limited to a 2'-O-methyl modified nucleoside, a nucleoside comprising a 5' phosphorothioate group, a terminal nucleoside linked to a cholesteryl derivative or dodecanoic acid bisdecylamide group, a locked nucleoside, an abasic nucleoside, an acyclic nucleoside, a glycol nucleotide, a 2'-deoxy-2'-fluoro modified nucleoside, a 2'-amino-modified nucleoside, 2'-alkyl-modified nucleoside, morpholino nucleoside, a phosphoramidate or a non-natural base comprising nucleoside, or any combination thereof. Alternatively, or in combination, an RNA molecule can comprise at least two modified ribonucleosides, at least 3, at least 4, at least 5, at least 6, at least 7, at least 8, at least 9, at least 10, at least 15, at least 20 or more, up to the entire length of the dsRNA molecule. The modifications need not be the same for each of such a plurality of modified ribonucleosides in an RNA molecule. In some embodiments, modified RNAs contemplated for use in methods and compositions described herein are peptide nucleic acids (PNAs) that have the ability to form the required duplex structure and that permit or mediate the specific degradation of a target RNA, e.g., via a RISC pathway. For clarity, it is understood that the term "iRNA" does not encompass a naturally occurring double stranded DNA molecule or a 100% deoxynucleoside-containing DNA molecule.

In some aspects, a modified ribonucleoside includes a deoxyribonucleoside. In such an instance, an iRNA agent can comprise one or more deoxynucleosides, including, for example, a deoxynucleoside overhang(s), or one or more deoxynucleosides within the double stranded portion of a dsRNA. In certain embodiments, the RNA molecule comprises a percentage of deoxyribonucleosides of at least 5, 10, 15, 20, 25, 30, 35, 40, 45, 50, 55, 60, 65, 70, 75, 80, 85, 90, 95% or higher (but not 100%) deoxyribonucleosides, e.g., in one or both strands.

As used herein, the term "nucleotide overhang" refers to at least one unpaired nucleotide that protrudes from the duplex structure of an iRNA, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively, the overhang can comprise at least two nucleotides, at least three nucleotides, at least four nucleotides, or at least five nucleotides or more. A nucleotide overhang can comprise or consist of a nucleotide/nucleoside analog, including a deoxynucleotide/nucleoside. The overhang(s) may be on the sense strand, the antisense strand or any combination thereof. Furthermore, the nucleotide(s) of an overhang can be present on the 5' end, 3' end or both ends of either an antisense or sense strand of a dsRNA.

In some embodiments, the antisense strand of a dsRNA has a 1-10 nucleotide overhang at the 3' end and/or the 5' end. In some embodiments, the sense strand of a dsRNA has a 1-10 nucleotide overhang at the 3' end and/or the 5' end. In some embodiments, one or more of the nucleotides in the overhang is replaced with a nucleoside thiophosphate.

As used herein, a "pharmaceutical composition" comprises a pharmacologically effective amount of a therapeutic agent (e.g., an iRNA) and a pharmaceutically acceptable carrier. As used herein, "pharmacologically effective amount," "therapeutically effective amount" or simply "effective amount" refers to that amount of an agent (e.g., iRNA) effective to produce the intended pharmacological, therapeutic or preventive result. For example, in a method of treating a disorder related to VEGF-A expression (e.g., an angiogenic ocular disorder), an effective amount includes an amount effective to reduce one or more symptoms associated with the disorder (e.g., an amount effective to (a) inhibit angiogenesis; (b) inhibit or reduces the expression or activity of VEGF-A; (c) inhibit choroidal neovascularization; (d) inhibit growth of new blood vessels in the choriocapillaris; (e) reduce retinal thickness; (f) increase visual acuity; or (g) reduce intraocular inflammation) or an amount effective to reduce the risk of developing conditions associated with the disorder. For example, if a given clinical treatment is considered effective when there is at least a 10% reduction in a measurable parameter associated with a disease or disorder, a therapeutically effective amount of a drug for the treatment of that disease or disorder is the amount necessary to obtain at least a 10% reduction in that parameter. For example, a therapeutically effective amount of an iRNA targeting VEGF-A can reduce a level of VEGF-A mRNA or a level of VEGF-A protein by any measurable amount, e.g., by at least 10%, 15%, 20%, 25%, 30%, 35%, 40%, 45%, 50%, 55%, 60%, 65%, 70%, 75%, 80%, 85%, 90%, or 95%.

The term "pharmaceutically acceptable carrier" refers to a carrier for administration of a therapeutic agent. Such carriers include, but are not limited to, saline, buffered saline, dextrose, water, glycerol, ethanol, and combinations thereof. The term specifically excludes cell culture medium. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. Agents included in drug formulations are described further herein below.

As used herein, the term "SNALP" refers to a stable nucleic acid-lipid particle. A SNALP represents a vesicle of lipids coating a reduced aqueous interior comprising a nucleic acid such as an iRNA or a plasmid from which an iRNA is transcribed. SNALPs are described, e.g., in U.S. Patent Application Publication Nos. 2006/0240093, 2007/0135372, and in International Application No. WO 2009/082817. These applications are incorporated herein by reference in their entirety. In some embodiments, the SNALP is a SPLP. As used herein, the term "SPLP" refers to a nucleic acid-lipid particle comprising plasmid DNA encapsulated within a lipid vesicle.

As used herein, the term "strand comprising a sequence" refers to an oligonucleotide comprising a chain of nucleotides that is described by the sequence referred to using the standard nucleotide nomenclature.

As used herein, a "subject" to be treated according to the methods described herein, includes a human or non-human animal, e.g., a mammal. The mammal may be, for example, a rodent (e.g., a rat or mouse) or a primate (e.g., a monkey). In some embodiments, the subject is a human.

A "subject in need thereof" includes a subject having, suspected of having, or at risk of developing a disorder related to VEGF-A expression, e.g., overexpression (e.g., an angiogenic ocular disorder). In some embodiments, the subject has, or is suspected of having, a disorder related to VEGF-A expression or overexpression. In some embodiments, the subject is at risk of developing a disorder related to VEGF-A expression or overexpression.

As used herein, "target sequence" refers to a contiguous portion of the nucleotide sequence of an mRNA molecule formed during the transcription of a gene, e.g., VEGF-A, including mRNA that is a product of RNA processing of a primary transcription product. The target portion of the sequence will be at least long enough to serve as a substrate for iRNA-directed cleavage at or near that portion. For example, the target sequence will generally be from 9-36 nucleotides in length, e.g., 15-30 nucleotides in length, including all subranges therebetween. As non-limiting examples, the target sequence can be from 15-30 nucleotides, 15-26 nucleotides, 15-23 nucleotides, 15-22 nucleotides, 15-21 nucleotides, 15-20 nucleotides, 15-19 nucleotides, 15-18 nucleotides, 15-17 nucleotides, 18-30 nucleotides, 18-26 nucleotides, 18-23 nucleotides, 18-22 nucleotides, 18-21 nucleotides, 18-20 nucleotides, 19-30 nucleotides, 19-26 nucleotides, 19-23 nucleotides, 19-22 nucleotides, 19-21 nucleotides, 19-20 nucleotides, 20-30 nucleotides, 20-26 nucleotides, 20-25 nucleotides, 20-24 nucleotides, 20-23 nucleotides, 20-22 nucleotides, 20-21 nucleotides, 21-30 nucleotides, 21-26 nucleotides, 21-25 nucleotides, 21-24 nucleotides, 21-23 nucleotides, or 21-22 nucleotides.

As used herein, the phrases "therapeutically effective amount" and "prophylactically effective amount" and the like refer to an amount that provides a therapeutic benefit in the treatment, prevention, or management of any disorder or pathological process related to VEGF-A expression (e.g., an angiogenic ocular disorder). The specific amount that is therapeutically effective may vary depending on factors known in the art, such as, for example, the type of disorder or pathological process, the patient's history and age, the stage of the disorder or pathological process, and the administration of other therapies.

In the context of the present disclosure, the terms "treat," "treatment," and the like mean to prevent, delay, relieve or alleviate at least one symptom associated with a disorder related to VEGF-A expression, or to slow or reverse the progression or anticipated progression of such a disorder. For example, the methods featured herein, when employed to treat an angiogenic ocular disorder, may serve to reduce or prevent one or more symptoms of the angiogenic ocular disorder, as described herein, or to reduce the risk or severity of associated conditions. Thus, unless the context clearly indicates otherwise, the terms "treat," "treatment," and the like are intended to encompass prophylaxis, e.g., prevention of disorders and/or symptoms of disorders related to VEGF-A expression. Treatment can also mean prolonging survival as compared to expected survival in the absence of treatment.

By "lower" in the context of a disease marker or symptom is meant any decrease, e.g., a statistically or clinically significant decrease in such level. The decrease can be, for example, at least 10%, at least 20%, at least 30%, at least 40%, at least 40%, at least 50%, at least 60%, at least 70%, at least 80%, or at least 90%. The decrease can be down to a level accepted as within the range of normal for an individual without such disorder.

As used herein, "VEGF-A" refers to "vascular endothelial growth factor A" the corresponding mRNA ("VEGF-A mRNA"), or the corresponding protein ("VEGF-A protein"). The sequence of a human VEGF-A mRNA transcript can be found at SEQ ID NO: 1.

II. iRNA Agents

Described herein are iRNA agents that modulate (e.g., inhibit) the expression of VEGF-A.

In some embodiments, the iRNA agent activates the expression of VEGF-A in a cell or mammal.

In some embodiments, the iRNA agent includes double-stranded ribonucleic acid (dsRNA) molecules for inhibiting the expression of VEGF-A in a cell or in a subject (e.g., in a mammal, e.g., in a human), where the dsRNA includes an antisense strand having a region of complementarity which is complementary to at least a part of an mRNA formed in the expression of VEGF-A, and where the region of complementarity is 30 nucleotides or less in length, generally 19-24 nucleotides in length, and where the dsRNA, upon contact with a cell expressing VEGF-A, inhibits the expression of VEGF-A, e.g., by at least 10%, 20%, 30%, 40%, or 50%.

The modulation (e.g., inhibition) of expression of VEGF-A can be assayed by, for example, a PCR or branched DNA (bDNA)-based method, or by a protein-based method, such as by Western blot. Expression of VEGF-A in cell culture, such as in COS cells, ARPE-19 cells, hTERT RPE-1 cells, HeLa cells, primary hepatocytes, HepG2 cells, primary cultured cells or in a biological sample from a subject can be assayed by measuring VEGF-A mRNA levels, such as by bDNA or TaqMan assay, or by measuring protein levels, such as by immunofluorescence analysis, using, for example, Western Blotting or flow cytometric techniques.

A dsRNA typically includes two RNA strands that are sufficiently complementary to hybridize to form a duplex structure under conditions in which the dsRNA will be used. One strand of a dsRNA (the antisense strand) typically includes a region of complementarity that is substantially complementary, and generally fully complementary, to a target sequence, derived from the sequence of an mRNA formed during the expression of VEGF-A. The other strand (the sense strand) typically includes a region that is complementary to the antisense strand, such that the two strands hybridize and form a duplex structure when combined under suitable conditions. Generally, the duplex structure is between 15 and 30 inclusive, more generally between 18 and 25 inclusive, yet more generally between 19 and 24 inclusive, and most generally between 19 and 21 base pairs in length, inclusive. Similarly, the region of complementarity to the target sequence is between 15 and 30 inclusive, more generally between 18 and 25 inclusive, yet more generally between 19 and 24 inclusive, and most generally between 19 and 21 nucleotides in length, inclusive.

In some embodiments, the dsRNA is between 15 and 20 nucleotides in length, inclusive, and in other embodiments, the dsRNA is between 25 and 30 nucleotides in length, inclusive. As the ordinarily skilled person will recognize, the targeted region of an RNA targeted for cleavage will most often be part of a larger RNA molecule, often an mRNA molecule. Where relevant, a "part" of an mRNA target is a contiguous sequence of an mRNA target of sufficient length to be a substrate for RNAi-directed cleavage (i.e., cleavage through a RISC pathway). dsRNAs having duplexes as short as 9 base pairs can, under some circumstances, mediate RNAi-directed RNA cleavage. Most often a target will be at least 15 nucleotides in length, e.g., 15-30 nucleotides in length.

One of skill in the art will also recognize that the duplex region is a primary functional portion of a dsRNA, e.g., a duplex region of 9 to 36, e.g., 15-30 base pairs. Thus, in some embodiments, to the extent that it becomes processed to a functional duplex of e.g., 15-30 base pairs that targets a desired RNA for cleavage, an RNA molecule or complex of RNA molecules having a duplex region greater than 30 base pairs is a dsRNA. Thus, an ordinarily skilled artisan will recognize that in some embodiments, then, an miRNA is a dsRNA. In some embodiments, a dsRNA is not a naturally occurring miRNA. In some embodiments, an iRNA agent useful to target VEGF-A expression is not generated in the target cell by cleavage of a larger dsRNA.

A dsRNA as described herein may further include one or more single-stranded nucleotide overhangs. The dsRNA can be synthesized by standard methods known in the art as further discussed below, e.g., by use of an automated DNA synthesizer, such as are commercially available from, for example, Biosearch, Applied Biosystems, Inc.

In some embodiments, VEGF-A is a human VEGF-A.

In specific embodiments, the dsRNA comprises a sense strand that comprises or consists of a sense sequence selected from the sense sequences provided in Tables 2A, 2B, 3A, 3B, 4A, 4B, 5A, 5B, 8A, 8B, 10A, 10B, 12, 13, 14, 18A or 18B and an antisense strand that comprises or consists of an antisense sequence selected from the antisense sequences provided in Tables 2A, 2B, 3A, 3B, 4A, 4B, 5A, 5B, 8A, 8B, 10A, 10B, 12, 13, 14, 18A or 18B.

In some aspects, a dsRNA will include at least sense and antisense nucleotide sequences, whereby the sense strand is selected from the sequences provided in Tables 2A, 2B, 3A, 3B, 4A, 4B, 5A, 5B, 8A, 8B, 10A, 10B, 12, 13, 14, 18A or 18B and the corresponding antisense strand is selected from the sequences provided in Tables 2A, 2B, 3A, 3B, 4A, 4B, 5A, 5B, 8A, 8B, 10A, 10B, 12, 13, 14, 18A or 18B.

In these aspects, one of the two sequences is complementary to the other of the two sequences, with one of the sequences being substantially complementary to a sequence of an mRNA generated by the expression of VEGF-A. As such, a dsRNA will include two oligonucleotides, where one oligonucleotide is described as the sense strand, and the second oligonucleotide is described as the corresponding antisense strand. As described elsewhere herein and as known in the art, the complementary sequences of a dsRNA can also be contained as self-complementary regions of a single nucleic acid molecule, as opposed to being on separate oligonucleotides.

The skilled person is well aware that dsRNAs having a duplex structure of between 20 and 23, but specifically 21, base pairs have been hailed as particularly effective in inducing RNA interference (Elbashir et al., *EMBO* 2001, 20:6877-6888). However, others have found that shorter or longer RNA duplex structures can be effective as well.

In the embodiments described above, by virtue of the nature of the oligonucleotide sequences provided in Tables 2A, 2B, 3A, 3B, 4A, 4B, 5A, 5B, 8A, 8B, 10A, 10B, 12, 13, 14, 18A and 18B, dsRNAs described herein can include at least one strand of a length of minimally 19 nucleotides. It can be reasonably expected that shorter duplexes having one of the sequences of Tables 2A, 2B, 3A, 3B, 4A, 4B, 5A, 5B, 8A, 8B, 10A, 10B, 12, 13, 14, 18A and 18B minus only a few nucleotides on one or both ends will be similarly effective as compared to the dsRNAs described above.

In some embodiments, the dsRNA has a partial sequence of at least 15, 16, 17, 18, 19, 20, or more contiguous nucleotides from one of the sequences of Tables 2A, 2B, 3A, 3B, 4A, 4B, 5A, 5B, 8A, 8B, 10A, 10B, 12, 13, 14, 18A or 18B.

In some embodiments, the dsRNA has an antisense sequence that comprises at least 15, 16, 17, 18, or 19 contiguous nucleotides of an antisense sequence provided in Tables 2A, 2B, 3A, 3B, 4A, 4B, 5A, 5B, 8A, 8B, 10A, 10B, 12, 13, 14, 18A or 18B and a sense sequence that comprises at least 15, 16, 17, 18, or 19 contiguous nucleotides of a corresponding sense sequence provided in Tables 2A, 2B, 3A, 3B, 4A, 4B, 5A, 5B, 8A, 8B, 10A, 10B, 12, 13, 14, 18A or 18B.

In some embodiments, the dsRNA comprises an antisense sequence that comprises at least 15, 16, 17, 18, 19, 20, 21, 22, or 23 contiguous nucleotides of an antisense sequence provided in Tables 2A, 2B, 3A, 3B, 4A, 4B, 5A, 5B, 8A, 8B, 10A, 10B, 12, 13, 14, 18A or 18B and a sense sequence that comprises at least 15, 16, 17, 18, 19, 20, or 21 contiguous nucleotides of a corresponding sense sequence provided in Tables 2A, 2B, 3A, 3B, 4A, 4B, 5A, 5B, 8A, 8B, 10A, 10B, 12, 13, 14, 18A or 18B.

In some such embodiments, the dsRNA, although it comprises only a portion of the sequences provided in Tables 2A, 2B, 3A, 3B, 4A, 4B, 5A, 5B, 8A, 8B, 10A, 10B, 12, 13, 14, 18A or 18B is equally effective in inhibiting a level of VEGF-A expression as is a dsRNA that comprises the full-length sequences provided in Tables 2A, 2B, 3A, 3B, 4A, 4B, 5A, 5B, 8A, 8B, 10A, 10B, 12, 13, 14, 18A or 18B. In some embodiments, the dsRNA differs in its inhibition of a level of expression of VEGF-A by not more than 5, 10, 15, 20, 25, 30, 35, 40, 45, or 50% inhibition compared with a dsRNA comprising the full sequence disclosed herein.

The iRNAs of Tables 5A and 5B were designed based on rat VEGF-A sequence. Without wishing to be bound by theory, VEGF-A sequence is conserved sufficiently between species such that certain iRNAs designed based on a rodent sequence have activity against a primate VEGF-A. Working Example 2 herein gives evidence of iRNAs designed based on a rodent sequence having activity against cynomolgus monkey VEGF-A.

Consequently, in some embodiments, an iRNA of Table 5A or Table 5B decreases VEGF-A protein or VEGF-A mRNA levels in a cell. In some embodiments, the cell is a rodent cell (e.g., a rat cell), or a primate cell (e.g., a cynomolgus monkey cell or a human cell). In some embodiments, VEGF-A protein or VEGF-F mRNA levels are reduced by at least 30%, 40%, 50%, 60%, 70%, 80%, 90%, or 95%. In some embodiments, the iRNA of Table 5A or 5B that inhibits VEGF-A in a human cell has less than 5, 4, 3, 2, or 1 mismatches to the corresponding portion of human VEGF-A. In some embodiments, the iRNA of Table 5A or 5B that inhibits VEGF-A in a human cell has no mismatches to the corresponding portion of human VEGF-A.

iRNAs designed based on rodent sequences can have utility, e.g., for inhibiting VEGF-A in human cells, e.g., for therapeutic purposes, or for inhibiting VEGF-A in rodent cells, e.g., for research characterizing VEGF-A in a rodent model.

In some embodiments, an iRNA described herein comprises an antisense strand comprising at least 15 contiguous nucleotides, with 0, 1, 2, or 3 mismatches, of a portion of nucleotide sequence of SEQ ID NO: 2. In some embodiments, an iRNA described herein comprises a sense strand comprising at least 15 contiguous nucleotides, with 0, or 1, 2, or 3 mismatches, of the corresponding portion of the nucleotide sequence of SEQ ID NO: 1.

A human VEGF-A mRNA may have the sequence of SEQ ID NO: 1 provided herein. *Homo sapiens* vascular endothelial growth factor A (VEGFA), transcript variant 1, mRNA

```
                                            (SEQ ID NO: 1)
TCGCGGAGGCTTGGGGCAGCCGGGTAGCTCGGAGGTCGTGGCGCTGGGGG

CTAGCACCAGCGCTCTGTCGGGAGGCGCAGCGGTTAGGTGGACCGGTCAG

CGGACTCACCGGCCAGGGCGCTCGGTGCTGGAATTTGATATTCATTGATC

CGGGTTTTATCCCTCTTCTTTTTTCTTAAACATTTTTTTTTAAAACTGTA

TTGTTTCTCGTTTTAATTTATTTTTGCTTGCCATTCCCCACTTGAATCGG

GCCGACGGCTTGGGGAGATTGCTCTACTTCCCCAAATCACTGTGGATTTT

GGAAACCAGCAGAAAGAGGAAAGAGGTAGCAAGAGCTCCAGAGAGAAGTC

GAGGAAGAGAGAGACGGGGTCAGAGAGAGCGCGCGGGCGTGCGAGCAGCG

AAAGCGACAGGGGCAAAGTGAGTGACCTGCTTTTGGGGGTGACCGCCGGA

GCGCGGCGTGAGCCCTCCCCCTTGGGATCCCGCAGCTGACCAGTCGCGCT
```

-continued

GACGGACAGACAGACAGACACCGCCCCCAGCCCCAGCTACCACCTCCTCC

CCGGCCGGCGGCGGACAGTGGACGCGGCGGCGAGCCGCGGGCAGGGGCCG

GAGCCCGCGCCCGGAGGCGGGGTGGAGGGGGTCGGGGCTCGCGGCGTCGC

ACTGAAACTTTTCGTCCAACTTCTGGGCTGTTCTCGCTTCGGAGGAGCCG

TGGTCCGCGCGGGGGAAGCCGAGCCGAGCGGAGCCGCGAGAAGTGCTAGC

TCGGGCCGGGAGGAGCCGCAGCCGGAGGAGGGGGAGGAGGAAGAAGAGAA

GGAAGAGGAGAGGGGGCCGCAGTGGCGACTCGGCGCTCGGAAGCCGGGCT

CATGGACGGGTGAGGCGGCGGTGTGCGCAGACAGTGCTCCAGCCGCGCGC

GCTCCCCAGGCCCTGGCCCGGGCCTCGGGCCGGGGAGGAAGAGTAGCTCG

CCGAGGCGCCGAGGAGAGCGGGCCGCCCCACAGCCCGAGCCGGAGAGGGA

GCGCGAGCCGCGCCGGCCCCGGTCGGGCCTCCGAAACCATGAACTTTCTG

CTGTCTTGGGTGCATTGGAGCCTTGCCTTGCTGCTCTACCTCCACCATGC

CAAGTGGTCCCAGGCTGCACCCATGGCAGAAGGAGGAGGGCAGAATCATC

ACGAAGTGGTGAAGTTCATGGATGTCTATCAGCGCAGCTACTGCCATCCA

ATCGAGACCCTGGTGGACATCTTCCAGGAGTACCCTGATGAGATCGAGTA

CATCTTCAAGCCATCCTGTGTGCCCCTGATGCGATGCGGGGGCTGCTGCA

ATGACGAGGGCCTGGAGTGTGTGCCCACTGAGGAGTCCAACATCACCATG

CAGATTATGCGGATCAAACCTCACCAAGGCCAGCACATAGGAGAGATGAG

CTTCCTACAGCACAACAAATGTGAATGCAGACCAAAGAAAGATAGAGCAA

GACAAGAAAAAAAATCAGTTCGAGGAAAGGGAAAGGGGCAAAAACGAAAG

CGCAAGAAATCCCGGTATAAGTCCTGGAGCGTGTACGTTGGTGCCCGCTG

CTGTCTAATGCCCTGGAGCCTCCCTGGCCCCCATCCCTGTGGGCCTTGCT

CAGAGCGGAGAAAGCATTTGTTTGTACAAGATCCGCAGACGTGTAAATGT

TCCTGCAAAAACACAGACTCGCGTTGCAAGGCGAGGCAGCTTGAGTTAAA

CGAACGTACTTGCAGATGTGACAAGCCGAGGCGGTGAGCCGGGCAGGAGG

AAGGAGCCTCCCTCAGGGTTTCGGGAACCAGATCTCTCACCAGGAAAGAC

TGATACAGAACGATCGATACAGAAACCACGCTGCCGCCACCACACCATCA

CCATCGACAGAACAGTCCTTAATCCAGAAACCTGAAATGAAGGAAGAGGA

GACTCTGCGCAGAGCACTTTGGGTCCGGAGGGCGAGACTCCGGCGGAAGC

ATTCCCGGGCGGGTGACCCAGCACGGTCCCTCTTGGAATTGGATTCGCCA

TTTTATTTTTCTTGCTGCTAAATCACCGAGCCCGGAAGATTAGAGAGTTT

TATTTCTGGGATTCCTGTAGACACACCCACCCACATACATACATTTATAT

ATATATATATTATATATATATAAAAATAAATATCTCTATTTTATATATAT

AAAATATATATATTCTTTTTTTAAATTAACAGTGCTAATGTTATTGGTGT

CTTCACTGGATGTATTTGACTGCTGTGGACTTGAGTTGGGAGGGGAATGT

TCCCACTCAGATCCTGACAGGGAAGAGGAGGAGATGAGAGACTCTGGCAT

GATCTTTTTTTTGTCCCACTTGGTGGGGCCAGGGTCCTCTCCCCTGCCCA

GGAATGTGGAAGGCCAGGGCATGGGGGCAAATATGACCCAGTTTTGGGAA

CACCGACAAACCCAGCCCTGGCGCTGAGCCTCTCTACCCCAGGTCAGACG

GACAGAAAGACAGATCACAGGTACAGGGATGAGGACACCGGCTCTGACCA

-continued

GGAGTTTGGGGAGCTTCAGGACATTGCTGTGCTTTGGGGATTCCCTCCAC

ATGCTGCACGCGCATCTCGCCCCCAGGGGCACTGCCTGGAAGATTCAGGA

GCCTGGGCGGCCTTCGCTTACTCTCACCTGCTTCTGAGTTGCCCAGGAGA

CCACTGGCAGATGTCCCGGCGAAGAGAAGAGACACATTGTTGGAAGAAGC

AGCCCATGACAGCTCCCCTTCCTGGGACTCGCCCTCATCCTCTTCCTGCT

CCCCTTCCTGGGGTGCAGCCTAAAAGGACCTATGTCCTCACACCATTGAA

ACCACTAGTTCTGTCCCCCCAGGAGACCTGGTTGTGTGTGTGTGAGTGGT

TGACCTTCCTCCATCCCCTGGTCCTTCCCTTCCCTTCCCGAGGCACAGAG

AGACAGGGCAGGATCCACGTGCCCATTGTGGAGGCAGAGAAAAGAGAAAG

TGTTTTATATACGGTACTTATTTAATATCCCTTTTTAATTAGAAATTAAA

ACAGTTAATTTAATTAAAGAGTAGGGTTTTTTTCAGTATTCTTGGTTAA

TATTTAATTTCAACTATTTATGAGATGTATCTTTTGCTCTCTCTTGCTCT

CTTATTTGTACCGGTTTTTGTATATAAAATTCATGTTTCCAATCTCTCTC

TCCCTGATCGGTGACAGTCACTAGCTTATCTTGAACAGATATTTAATTTT

GCTAACACTCAGCTCTGCCCTCCCCGATCCCCTGGCTCCCCAGCACACAT

TCCTTTGAAATAAGGTTTCAATATACATCTACATACTATATATATATTTG

GCAACTTGTATTTGTGTGTATATATATATATATATGTTTATGTATATATG

TGATTCTGATAAAATAGACATTGCTATTCTGTTTTTTATATGTAAAAACA

AAACAAGAAAAAATAGAGAATTCTACATACTAAATCTCTCTCCTTTTTTA

ATTTTAATATTTGTTATCATTTATTTATTGGTGCTACTGTTTATCCGTAA

TAATTGTGGGGAAAAGATATTAACATCACGTCTTTGTCTCTAGTGCAGTT

TTTCGAGATATTCCGTAGTACATATTTATTTTTAAACAACGACAAAGAAA

TACAGATATATCTTAAAAAAAAAAAAAGCATTTTGTATTAAAGAATTTAAT

TCTGATCTCAAAAAAAAAAAAAAAAAAA

The reverse complement of SEQ ID NO: 1 is provided as SEQ ID NO: 2 herein:

(SEQ ID NO: 2)

TTTTTTTTTTTTTTTTTTTGAGATCAGAATTAAATTCTTTAATACAAAATG

CTTTTTTTTTTTTTAAGATATATCTGTATTTCTTTGTCGTTGTTTAAAAAT

AAATATGTACTACGGAATATCTCGAAAAACTGCACTAGAGACAAAGACGT

GATGTTAATATCTTTTCCCCACAATTATTACGGATAAACAGTAGCACCAA

TAAATAAATGATAACAAATATTAAAATTAAAAAAGGAGAGAGATTTAGTA

TGTAGAATTCTCTATTTTTTCTTGTTTTGTTTTTACATATAAAAAACAGA

ATAGCAATGTCTATTTTATCAGAATCACATATATACATAAACATATATAT

ATATATATACACACAAATACAAGTTGCCAAATATATATATAGTATGTAGA

TGTATATTGAAACCTTATTTCAAAGGAATGTGTGCTGGGGAGCCAGGGGA

TCGGGGAGGGCAGAGCTGAGTGTTAGCAAAATTAAATATCTGTTCAAGAT

AAGCTAGTGACTGTCACCGATCAGGGAGAGAGAGATTGGAAACATGAATT

TTATATACAAAAACCGGTACAAATAAGAGAGCAAGAGAGAGCAAAAGATA

CATCTCATAAATAGTTGAAATTAAATATTAACCAAGAATACTGAAAAAAA

ACCCTACTCTTTAATTAAATTAACTGTTTTAATTTCTAATTAAAAAGGGA

-continued

TATTAAATAAGTACCGTATATAAAACACTTTCTCTTTTCTCTGCCTCCAC

AATGGGCACGTGGATCCTGCCCTGTCTCTCTGTGCCTCGGGAAGGGAAGG

GAAGGACCAGGGGATGGAGGAAGGTCAACCACTCACACACACACAACCAG

GTCTCCTGGGGGGACAGAACTAGTGGTTTCAATGGTGTGAGGACATAGGT

CCTTTTAGGCTGCACCCCAGGAAGGGGAGCAGGAAGAGGATGAGGGCGAG

TCCCAGGAAGGGGAGCTGTCATGGGCTGCTTCTTCCAACAATGTGTCTCT

TCTCTTCGCCGGGACATCTGCCAGTGGTCTCCTGGGCAACTCAGAAGCAG

GTGAGAGTAAGCGAAGGCCGCCCAGGCTCCTGAATCTTCCAGGCAGTGCC

CCTGGGGGCGAGATGCGCGTGCAGCATGTGGAGGGAATCCCCAAAGCACA

GCAATGTCCTGAAGCTCCCCAAACTCCTGGTCAGAGCCGGTGTCCTCATC

CCTGTACCTGTGATCTGTCTTTCTGTCCGTCTGACCTGGGGTAGAGAGGC

TCAGCGCCAGGGCTGGGTTTGTCGGTGTTCCCAAAACTGGGTCATATTTG

CCCCCATGCCCTGGCCTTGCACATTCCTGGGCAGGGGAGAGGACCCTGGC

CCCACCAAGTGGGACAAAAAAAAGATCATGCCAGAGTCTCTCATCTCCTC

CTCTTCCCTGTCAGGATCTGAGTGGGAACATTCCCCTCCCAACTCAAGTC

CACAGCAGTCAAATACATCCAGTGAAGACACCAATAACATTAGCACTGTT

AATTTAAAAAAAGAATATATATATTTTATATATATAAAATAGAGATATTT

ATTTTTATATATATATAATATATATATATATAAATGTATGTATGTGGGTG

GGTGTGTCTACAGGAATCCCAGAAATAAAACTCTCTAATCTTCCGGGCTC

GGTGATTTAGCAGCAAGAAAAATAAAATGGCGAATCCAATTCCAAGAGGG

ACCGTGCTGGGTCACCCGCCCGGGAATGCTTCCGCCGGAGTCTCGCCCTC

CGGACCCAAAGTGCTCTGCGCAGAGTCTCCTCTTCCTTCATTTCAGGTTT

CTGGATTAAGGACTGTTCTGTCGATGGTGATGGTGTGGTGGCGGCAGCGT

GGTTTCTGTATCGATCGTTCTGTATCAGTCTTTCCTGGTGAGAGATCTGG

TTCCCGAAACCCTGAGGGAGGCTCCTTCCTCCTGCCCGGCTCACCGCCTC

GGCTTGTCACATCTGCAAGTACGTTCGTTTAACTCAAGCTGCCTCGCCTT

GCAACGCGAGTCTGTGTTTTTGCAGGAACATTTACACGTCTGCGGATCTT

GTACAAACAAATGCTTTCTCCGCTCTGAGCAAGGCCCACAGGGATGGGGG

CCAGGGAGGCTCCAGGGCATTAGACAGCAGCGGGCACCAACGTACACGCT

CCAGGACTTATACCGGGATTTCTTGCGCTTTCGTTTTTGCCCCTTTCCCT

TTCCTCGAACTGATTTTTTTTCTTGTCTTGCTCTATCTTTCTTTGGTCTG

CATTCACATTTGTTGTGCTGTAGGAAGCTCATCTCTCCTATGTGCTGGCC

TTGGTGAGGTTTGATCCGCATAATCTGCATGGTGATGTTGGACTCCTCAG

TGGGCACACACTCCAGGCCCTCGTCATTGCAGCAGCCCCCGCATCGCATC

AGGGGCACACAGGATGGCTTGAAGATGTACTCGATCTCATCAGGGTACTC

CTGGAAGATGTCCACCAGGGTCTCGATTGGATGGCAGTAGCTGCGCTGAT

AGACATCCATGAACTTCACCACTTCGTGATGATTCTGCCCTCCTCCTTCT

GCCATGGGTGCAGCCTGGGACCACTTGGCATGGTGGAGGTAGAGCAGCAA

GGCAAGGCTCCAATGCACCCAAGACAGCAGAAAGTTCATGGTTTCGGAGG

CCCGACCGGGGCCGGCGCGGCTCGCGCTCCCTCTCCGGCTCGGGCTGTGG

-continued

GGCGGCCCGCTCTCCTCGGCGCCTCGGCGAGCTACTCTTCCTCCCCGGCC

CGAGGCCCGGGCCAGGGCCTGGGGAGCGCGCGGCTGGAGCACTGTCTG

CGCACACCGCCGCCTCACCCGTCCATGAGCCCGGCTTCCGAGCGCCGAGT

CGCCACTGCGGCCCCCTCTCCTCTTCCTTCTCTTCTTCCTCCTCCCCCTC

CTCCGGCTGCGGCTCCTCCCGGCCCGAGCTAGCACTTCTCGCGGCTCCGC

TCGGCTCGGCTTCCCCCGCGCGGACCACGGCTCCTCCGAAGCGAGAACAG

CCCAGAAGTTGGACGAAAAGTTTCAGTGCGACGCCGCGAGCCCCGACCCC

CTCCACCCCGCCTCCGGGCGCGGGCTCCGGCCCCTGCCCGCGGCTCGCCG

CCGCGTCCACTGTCCGCCGCCGGCCGGGGAGGAGGTGGTAGCTGGGGCTG

GGGGCGGTGTCTGTCTGTCTGTCCGTCAGCGCGACTGGTCAGCTGCGGGA

TCCCAAGGGGGAGGGCTCACGCCGCGCTCCGGCGGTCACCCCCAAAAGCA

GGTCACTCACTTTGCCCCTGTCGCTTTCGCTGCTCGCACGCCCGCGCGCT

CTCTCTGACCCCGTCTCTCTCTTCCTCGACTTCTCTCTGGAGCTCTTGCT

ACCTCTTTCCTCTTTCTGCTGGTTTCCAAAATCCACAGTGATTTGGGGAA

GTAGAGCAATCTCCCCAAGCCGTCGGCCCGATTCAAGTGGGGAATGGCAA

GCAAAAATAAATTAAAACGAGAAACAATACAGTTTTAAAAAAAAATGTTT

AAGAAAAAAGAAGAGGGATAAAACCCGGATCAATGAATATCAAATTCCAG

CACCGAGCGCCCTGGCCGGTGAGTCCGCTGACCGGTCCACCTAACCGCTG

CGCCTCCCGACAGAGCGCTGGTGCTAGCCCCCAGCGCCACGACCTCCGAG

CTACCCGGCTGCCCCAAGCCTCCGCGA

In some embodiments, an iRNA described herein includes at least 15 contiguous nucleotides from one of the sequences provided in Tables 2A, 2B, 3A, 3B, 4A, 4B, 5A, 5B, 8A, 8B, 10A, 10B, 12, 13, 14, 18A and 18B, and may optionally be coupled to additional nucleotide sequences taken from the region contiguous to the selected sequence in VEGF-A.

While a target sequence is generally 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that may serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays described herein or known in the art) to identify those sequences that perform optimally can identify those RNA sequences that, when targeted with an iRNA agent, mediate the best inhibition of target gene expression. Thus, it is contemplated that further optimization of inhibition efficiency can be achieved by progressively "walking the window" one nucleotide upstream or downstream of the given sequences to identify sequences with equal or better inhibition characteristics.

Further, it is contemplated that for any sequence identified, e.g., in Tables 2A, 2B, 3A, 3B, 4A, 4B, 5A, 5B, 8A, 8B, 10A, 10B, 12, 13, 14, 18A and 18B, further optimization can be achieved by systematically either adding or removing nucleotides to generate longer or shorter sequences and testing those and sequences generated by walking a window of the longer or shorter size up or down the target RNA from that point. Again, coupling this approach to generating new candidate targets with testing for effectiveness of iRNAs based on those target sequences in an inhibition assay as known in the art or as described herein can lead to further improvements in the efficiency of inhibition. Further still, such optimized sequences can be adjusted by, e.g., the introduction of modified nucleotides as described herein or as known in the art, addition or changes in overhang, or other modifications as known in the art and/or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes, etc.) as an expression inhibitor.

In some embodiments, the disclosure provides an iRNA of any of Tables 2B, 3B, 4B, 5B, 8B, 10B, 14, or 18B that un-modified or un-conjugated. In some embodiments, an RNAi agent of the disclosure has a nucleotide sequence as provided in any of Tables 2A, 3A, 4A, 5A, 8A, 10A, 12, 13 14, and 18A but lacks one or more ligand or moiety shown in the table. A ligand or moiety (e.g., a lipophilic ligand or moiety) can be included in any of the positions provided in the instant application.

An iRNA as described herein can contain one or more mismatches to the target sequence. In some embodiments, an iRNA as described herein contains no more than 3 mismatches. In some embodiments, when the antisense strand of the iRNA contains mismatches to a target sequence, the area of mismatch is not located in the center of the region of complementarity. In some embodiments, when the antisense strand of the iRNA contains mismatches to the target sequence, the mismatch is restricted to be within the last 5 nucleotides from either the 5' or 3' end of the region of complementarity. For example, for a 23 nucleotide iRNA agent RNA strand which is complementary to a region of VEGF-A, the RNA strand generally does not contain any mismatch within the central 13 nucleotides. The methods described herein, or methods known in the art can be used to determine whether an iRNA containing a mismatch to a target sequence is effective in inhibiting the expression of VEGF-A. Consideration of the efficacy of iRNAs with mismatches in inhibiting expression of VEGF-A is important, especially if the particular region of complementarity in a VEGF-A gene is known to have polymorphic sequence variation within the population.

In some embodiments, at least one end of a dsRNA has a single-stranded nucleotide overhang of 1 to 4, generally 1 or 2 nucleotides. In some embodiments, dsRNAs having at least one nucleotide overhang have superior inhibitory properties relative to their blunt-ended counterparts. In some embodiments, the RNA of an iRNA (e.g., a dsRNA) is chemically modified to enhance stability or other beneficial characteristics. The nucleic acids featured in the disclosure may be synthesized and/or modified by methods well established in the art, such as those described in "Current protocols in nucleic acid chemistry," Beaucage, S. L. et al. (Edrs.), John Wiley & Sons, Inc., New York, NY, USA, which is hereby incorporated herein by reference. Modifications include, for example, (a) end modifications, e.g., 5' end modifications (phosphorylation, conjugation, inverted linkages, etc.) 3' end modifications (conjugation, DNA nucleotides, inverted linkages, etc.), (b) base modifications, e.g., replacement with stabilizing bases, destabilizing bases, or bases that base pair with an expanded repertoire of partners, removal of bases (abasic nucleotides), or conjugated bases, (c) sugar modifications (e.g., at the 2' position or 4' position, or having an acyclic sugar) or replacement of the sugar, as well as (d) backbone modifications, including modification or replacement of the phosphodiester linkages. Specific examples of RNA compounds useful in this disclosure include, but are not limited to, RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In particular embodiments, the modified RNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those) having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and RE39464, each of which is herein incorporated by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289;

5,618,704; 5,623,070; 5,663,312; 5,633,360; 5,677,437; and, 5,677,439, each of which is herein incorporated by reference.

In other RNA mimetics suitable or contemplated for use in iRNAs, both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found, for example, in Nielsen et al., Science, 1991, 254, 1497-1500.

Some embodiments featured in the disclosure include RNAs with phosphorothioate backbones and oligonucleosides with heteroatom backbones, and in particular $—CH_2—NH—CH_2—$, $—CH_2—N(CH_3)—O—CH_2—$[known as a methylene (methylimino) or MMI backbone], $—CH_2—O—N(CH_3)—CH_2—$, $—CH_2—N(CH_3)—N(CH_3)—CH_2—$ and $—N(CH_3)—CH_2—CH_2—$ [wherein the native phosphodiester backbone is represented as $—O—P—O—CH_2—$] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs may also contain one or more substituted sugar moieties. The iRNAs, e.g., dsRNAs, featured herein can include one of the following at the 2' position: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)\cdot_nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy ($2'-O—CH_2CH_2OCH_3$, also known as 2'-O-(2-methoxyethyl) or 2'-MOE) (Martin et al., *Helv. Chim. Acta,* 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, and 2'-dimethylaminoethoxyethoxy (also known in the art as 2'-O-dimethylaminoethoxyethyl or 2'-DMAEOE), i.e., $2'-O—CH_2—O—CH_2—N(CH_2)_2$.

In other embodiments, an iRNA agent comprises one or more (e.g., about 1, 2, 3, 4, 5, 6, 7, 8, 9, 10, or more) acyclic nucleotides (or nucleosides). In certain embodiments, the sense strand or the antisense strand, or both sense strand and antisense strand, include less than five acyclic nucleotides per strand (e.g., four, three, two or one acyclic nucleotides per strand). The one or more acyclic nucleotides can be found, for example, in the double-stranded region, of the sense or antisense strand, or both strands; at the 5'-end, the 3'-end, both of the 5' and 3'-ends of the sense or antisense strand, or both strands, of the iRNA agent. In some embodiments, one or more acyclic nucleotides are present at positions 1 to 8 of the sense or antisense strand, or both. In some embodiments, one or more acyclic nucleotides are found in the antisense strand at positions 4 to 10 (e.g., positions 6-8) from the 5'-end of the antisense strand. In some embodiments, the one or more acyclic nucleotides are found at one or both 3'-terminal overhangs of the iRNA agent.

Figure 1B:
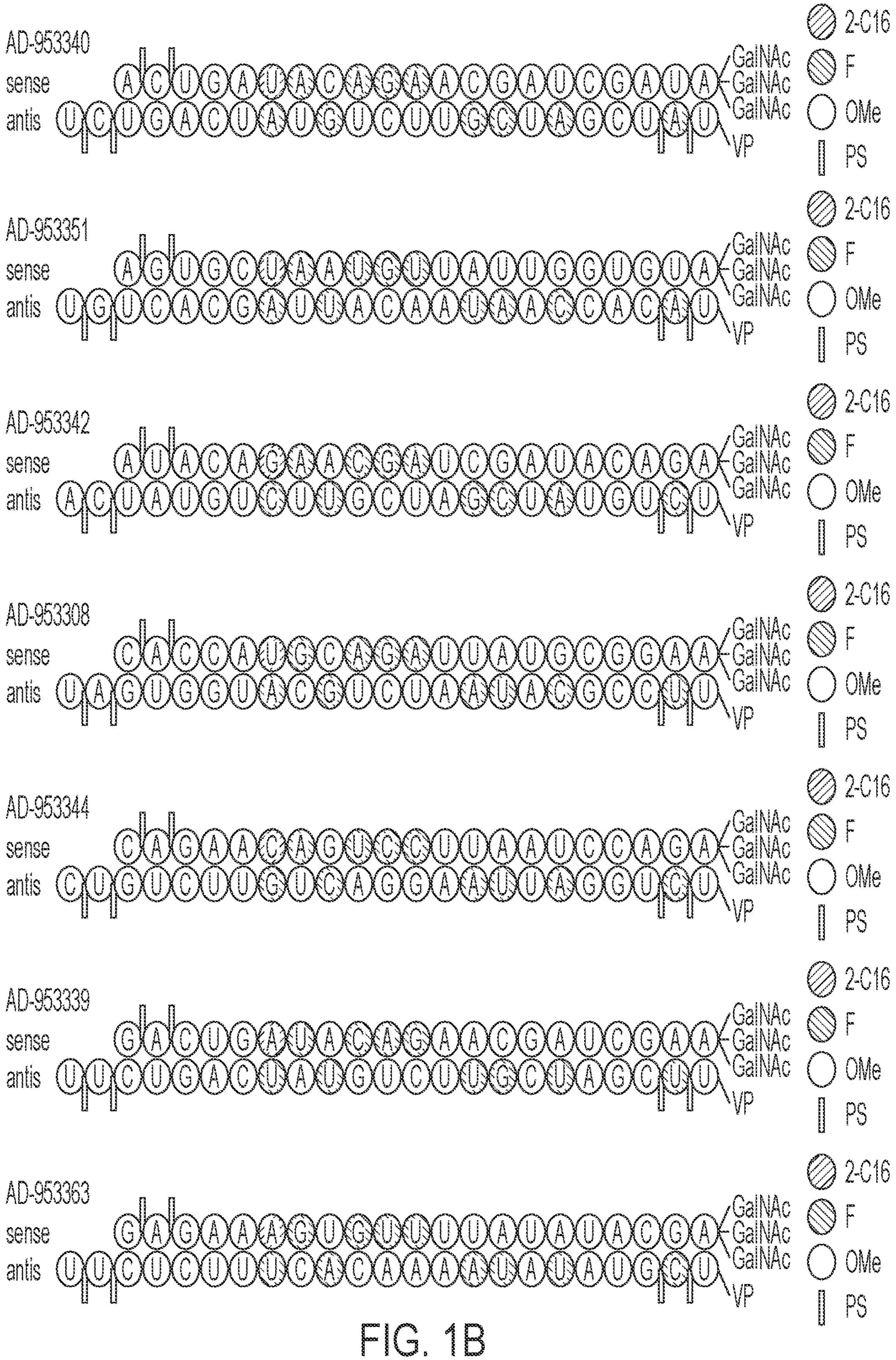
FIG. 1B depicts the sequences and chemistry of the exemplary VEGF-A siRNAs including AD-953340 (SEQ ID NO: 517 and 647), AD-953351 (SEQ ID NO: 540 and 670), AD-953342 (SEQ ID NO: 523 and 653), AD-953308 (SEQ ID NO: 579 and 709), AD-953344 (SEQ ID NO: 527 and 657), AD-953339 (SEQ ID NO: 528 and 658), and AD-953363 (SEQ ID NO: 519 and 649). For each siRNA, “F” is the “2'-fluoro” modification, OMe is a methoxy group, GNA refers to a glycol nucleic acid, “DNA” refers to a DNA base, 2-C16 refers to the targeting ligand, and PS refers to the phosphorothioate linkage.

The term "acyclic nucleotide" or "acyclic nucleoside" as used herein refers to any nucleotide or nucleoside having an acyclic sugar, e.g., an acyclic ribose. An exemplary acyclic nucleotide or nucleoside can include a nucleobase, e.g., a naturally occurring or a modified nucleobase (e.g., a nucleobase as described herein). In certain embodiments, a bond between any of the ribose carbons (C1, C2, C3, C4, or C5), is independently or in combination absent from the nucleotide. In some embodiments, the bond between C2-C3 carbons of the ribose ring is absent, e.g., an acyclic 2'-3'-seco-nucleotide monomer. In other embodiments, the bond between C1-C2, C3-C4, or C4-05 is absent (e.g., a 1'-2', 3'-4' or 4'-5'-seco nucleotide monomer). Exemplary acyclic nucleotides are disclosed in U.S. Pat. No. 8,314,227, incorporated herein by reference in its entirety. For example, an acyclic nucleotide can include any of monomers D-J in FIGS. 1-2 of U.S. Pat. No. 8,314,227. In some embodiments, the acyclic nucleotide includes the following monomer:

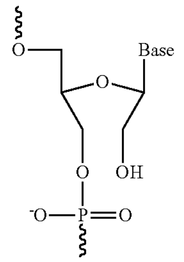

wherein Base is a nucleobase, e.g., a naturally occurring or a modified nucleobase (e.g., a nucleobase as described herein).

In certain embodiments, the acyclic nucleotide can be modified or derivatized, e.g., by coupling the acyclic nucleotide to another moiety, e.g., a ligand (e.g., a GalNAc, a cholesterol ligand), an alkyl, a polyamine, a sugar, a polypeptide, among others.

In other embodiments, the iRNA agent includes one or more acyclic nucleotides and one or more LNAs (e.g., an LNA as described herein). For example, one or more acyclic nucleotides and/or one or more LNAs can be present in the sense strand, the antisense strand, or both. The number of acyclic nucleotides in one strand can be the same or different from the number of LNAs in the opposing strand. In certain embodiments, the sense strand and/or the antisense strand comprises less than five LNAs (e.g., four, three, two or one LNAs) located in the double stranded region or a 3'-overhang. In other embodiments, one or two LNAs are located in the double stranded region or the 3'-overhang of the sense strand. Alternatively, or in combination, the sense strand and/or antisense strand comprises less than five acyclic nucleotides (e.g., four, three, two or one acyclic nucleotides) in the double-stranded region or a 3'-overhang. In some embodiments, the sense strand of the iRNA agent comprises one or two LNAs in the 3'-overhang of the sense strand, and one or two acyclic nucleotides in the double-stranded region of the antisense strand (e.g., at positions 4 to 10 (e.g., positions 6-8) from the 5'-end of the antisense strand) of the iRNA agent.

In other embodiments, inclusion of one or more acyclic nucleotides (alone or in addition to one or more LNAs) in the iRNA agent results in one or more (or all) of: (i) a reduction in an off-target effect; (ii) a reduction in passenger strand participation in RNAi; (iii) an increase in specificity of the guide strand for its target mRNA; (iv) a reduction in a microRNA off-target effect; (v) an increase in stability; or (vi) an increase in resistance to degradation, of the iRNA molecule.

Other modifications include 2'-methoxy (2'-$OCH_3$), 2'-5 aminopropoxy (2'-$OCH_2CH_2CH_2NH_2$) and 2'-fluoro (2'-F). Similar modifications may also be made at other positions on the RNA of an iRNA, particularly the 3' position of the sugar on the 3' terminal nucleotide or in 2'-5' linked dsRNAs and the 5' position of 5' terminal nucleotide. iRNAs may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application, and each of which is herein incorporated by reference.

An iRNA may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine.

Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia of Polymer Science and Engineering, pages 858-859, Kroschwitz, J. L, ed. John Wiley & Sons, 1990, these disclosed by Englisch et al., *Angewandte Chemie*, International Edition, 1991, 30, 613, and those disclosed by Sanghvi, Y S., Chapter 15*, dsRNA Research and Applications*, pages 289-302, Crooke, S. T. and Lebleu, B., Ed., CRC Press, 1993. Certain of these nucleobases are particularly useful for increasing the binding affinity of the oligomeric compounds featured in the disclosure. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 6,015,886; 6,147,200; 6,166,197; 6,222,025; 6,235,887; 6,380,368; 6,528,640; 6,639,062; 6,617,438; 7,045,610; 7,427,672; and 7,495,088, each of which is herein incorporated by reference, and U.S. Pat. No. 5,750,692, also herein incorporated by reference.

The RNA of an iRNA can also be modified to include one or more (e.g., about 1, 2, 3, 4, 5, 6, 7, 8, 9, 10, or more) bicyclic sugar moities. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the disclosure may include one or more locked nucleic acids (LNAs) (also referred to herein as "locked nucleotides"). In some embodiments, a locked nucleic acid is a nucleotide having a modified ribose moiety in which the ribose moiety comprises an extra bridge connecting, e.g., the 2' and 4' carbons. This structure effectively "locks" the ribose in the 3'-endo structural conformation. The addition of locked nucleic acids to siRNAs has been shown to increase siRNA stability in serum, increase thermal stability, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193).

Examples of bicyclic nucleosides for use in the polynucleotides of the disclosure include without limitation nucleosides comprising a bridge between the 4' and the 2' ribosyl ring atoms.

In certain embodiments, the antisense polynucleotide agents of the disclosure include one or more bicyclic nucleosides comprising a 4' to 2' bridge. Examples of such 4' to 2' bridged bicyclic nucleosides, include but are not limited to 4'-(CH2)-O-2' (LNA); 4'-(CH2)-S-2'; 4'-(CH2)2-O-2' (ENA); 4'-CH(CH3)-O-2' (also referred to as "constrained ethyl" or "cEt") and 4'-CH(CH2OCH3)-O-2' (and analogs thereof; see, e.g., U.S. Pat. No. 7,399,845); 4'-C(CH3)(CH3)-O-2' (and analogs thereof; see e.g., U.S. Pat. No. 8,278,283); 4'-CH2-N(OCH3)-2' (and analogs thereof; see e.g., U.S. Pat. No. 8,278,425); 4'-CH2-O—N(CH3)-2' (see, e.g., U.S. Patent Publication No. 2004/0171570); 4'-CH2-N(R)—O-2', wherein R is H, C1-C12 alkyl, or a protecting group (see, e.g., U.S. Pat. No. 7,427,672); 4'-CH2-C(H)(CH3)-2' (see, e.g., Chattopadhyaya et al., *J. Org. Chem.,* 2009, 74, 118-134); and 4'-CH2-C(=CH2)-2' (and analogs thereof; see, e.g., U.S. Pat. No. 8,278,426). The contents of each of the foregoing are incorporated herein by reference for the methods provided therein. Representative U.S. Patents that teach the preparation of locked nucleic acids include, but are not limited to, the following: U.S. Pat. Nos. 6,268,490; 6,670,461; 6,794,499; 6,998,484; 7,053,207; 7,084,125; 7,399,845, and 8,314,227, each of which is herein incorporated by reference in its entirety. Exemplary LNAs include but are not limited to, a 2', 4'-C methylene bicyclo nucleotide (see for example Wengel et al., International PCT 5 Publication No. WO 00/66604 and WO 99/14226).

Any of the foregoing bicyclic nucleosides can be prepared having one or more stereochemical sugar configurations including for example α-L-ribofuranose and β-D-ribofuranose (see WO 99/14226).

A RNAi agent of the disclosure can also be modified to include one or more constrained ethyl nucleotides. As used herein, a “constrained ethyl nucleotide” or “cEt” is a locked nucleic acid comprising a bicyclic sugar moiety comprising a 4'-CH(CH3)-O-2' bridge. In some embodiments, a constrained ethyl nucleotide is in the S conformation referred to herein as “S-cEt.”

A RNAi agent of the disclosure may also include one or more “conformationally restricted nucleotides” (“CRN”). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US 2013/0190383; and WO 2013/036868, the contents of each of which are hereby incorporated herein by reference for the methods provided therein. In some embodiments, a RNAi agent of the disclosure comprises one or more monomers that are UNA (unlocked nucleic acid) nucleotides. UNA is unlocked acyclic nucleic acid, wherein any of the bonds of the sugar has been removed, forming an unlocked “sugar” residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series,* 52, 133-134 (2008) and Fluiter et al., *Mol. Biosyst.,* 2009, 10, 1039).

Representative U.S. publications that teach the preparation of UNA include, but are not limited to, U.S. Pat. No. 8,314,227; and US Patent Publication Nos. 2013/0096289; 2013/0011922; and 2011/0313020, the contents of each of which are hereby incorporated herein by reference for the methods provided therein.

In other embodiments, the iRNA agents include one or more (e.g., about 1, 2, 3, 4, 5, 6, 7, 8, 9, 10, or more) G-clamp nucleotides. A G-clamp nucleotide is a modified cytosine analog wherein the modifications confer the ability to hydrogen bond both Watson-Crick and Hoogsteen faces of a complementary guanine within a duplex, see for example Lin and Matteucci, 1998, *J. Am. Chem. Soc.,* 120, 8531-8532. A single G-clamp analog substitution within an oligonucleotide can result in substantially enhanced helical thermal stability and mismatch discrimination when hybridized to complementary oligonucleotides. The inclusion of such nucleotides in the iRNA molecules can result in enhanced affinity and specificity to nucleic acid targets, complementary sequences, or template strands.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

Other modifications of a RNAi agent of the disclosure include a 5' phosphate or 5' phosphate mimic, e.g., a 5'-terminal phosphate or phosphate mimic on the antisense strand of a RNAi agent. Suitable phosphate mimics are disclosed in, for example US 2012/0157511, the contents of which are incorporated herein by reference for the methods provided therein.

iRNA Motifs

In certain aspects of the disclosure, the double-stranded RNAi agents of the disclosure include agents with chemical modifications as disclosed, for example, in WO 2013/075035, the contents of which are incorporated herein by reference for the methods provided therein. As shown herein and in WO 2013/075035, a superior result may be obtained by introducing one or more motifs of three identical modifications on three consecutive nucleotides into a sense strand or antisense strand of an RNAi agent, particularly at or near the cleavage site. In some embodiments, the sense strand and antisense strand of the RNAi agent may otherwise be completely modified. The introduction of these motifs interrupts the modification pattern, if present, of the sense or antisense strand. The RNAi agent may be optionally conjugated with a lipophilic moiety or ligand, e.g., a C16 moiety or ligand, for instance on the sense strand. The RNAi agent may be optionally modified with a (S)-glycol nucleic acid (GNA) modification, for instance on one or more residues of the antisense strand. The resulting RNAi agents present superior gene silencing activity.

In some embodiments, the sense strand sequence may be represented by formula (I):

$$5' n_p\text{-}N_a\text{-}(XXX)_i\text{-}N_b\text{-}YYY\text{-}N_b\text{-}(ZZZ)_j\text{-}N_a\text{-}n_q 3' \qquad (I)$$

wherein:

i and j are each independently 0 or 1;

p and q are each independently 0-6;

each $N_a$ independently represents an oligonucleotide sequence comprising 0-25 modified nucleotides, each sequence comprising at least two differently modified nucleotides;

each $N_b$ independently represents an oligonucleotide sequence comprising 0-10 modified nucleotides;

each $n_p$ and $n_q$ independently represent an overhang nucleotide;

wherein $N_b$ and Y do not have the same modification; and

XXX, YYY and ZZZ each independently represent one motif of three identical modifications on three consecutive nucleotides. In some embodiments, YYY is all 2'-F modified nucleotides.

In some embodiments, the $N_a$ and/or $N_b$ comprise modifications of alternating pattern.

In some embodiments, the YYY motif occurs at or near the cleavage site of the sense strand. For example, when the RNAi agent has a duplex region of 17-23 nucleotides in length, the YYY motif can occur at or the vicinity of the cleavage site (e.g.: can occur at positions 6, 7, 8; 7, 8, 9; 8, 9, 10; 9, 10, 11; 10, 11,12 or 11, 12, 13) of the sense strand, the count starting from the $1^{st}$ nucleotide, from the 5'-end; or optionally, the count starting at the $1_{st}$ paired nucleotide within the duplex region, from the 5'-end.

In some embodiments, i is 1 and j is 0, or i is 0 and j is 1, or both i and j are 1. The sense strand can therefore be represented by the following formulas:

$$5'n_p\text{-}N_a\text{-}YYY\text{-}N_b\text{-}ZZZ\text{-}N_a\text{-}n_q3' \quad \text{(Ib);}$$

$$5'n_p\text{-}N_a\text{-}XXX\text{-}N_b\text{-}YYY\text{-}N_a\text{-}n_q3' \quad \text{(Ic); or}$$

$$5'n_p\text{-}N_a\text{-}XXX\text{-}N_b\text{-}YYY\text{-}N_b\text{-}ZZZ\text{-}N_a\text{-}n_q3' \quad \text{(Id).}$$

When the sense strand is represented by formula (Ib), $N_b$ represents an oligonucleotide sequence comprising 0-10, 0-7, 0-5, 0-4, 0-2 or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-5, 0-4, 0-2 or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2 or 0 modified nucleotides. In some embodiments, $N_b$ 1S 0, 1, 2, 3, 4, 5 or 6. Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

$$5'n_p\text{-}N_a\text{-}YYY\text{-}N_a\text{-}n_q3' \quad \text{(Ia).}$$

When the sense strand is represented by formula (Ia), each $N_a$ independently can represent an oligonucleotide sequence comprising 2-20, 2-15, or 2-10 modified nucleotides.

In some embodiments, the antisense strand sequence of the RNAi may be represented by formula (II):

$$5'n_q'\text{-}N_a'\text{—}(Z'Z'Z')_k\text{—}N_b'\text{—}Y'Y'Y'\text{—}N_b'\text{—}(X'X'X')_l\text{—}N'_a\text{-}n_p'3' \quad \text{(II)}$$

wherein:

- k and l are each independently 0 or 1;
- p' and q' are each independently 0-6;
- each $N_a'$ independently represents an oligonucleotide sequence comprising 0-25 modified nucleotides, each sequence comprising at least two differently modified nucleotides;
- each $N_b'$ independently represents an oligonucleotide sequence comprising 0-10 modified nucleotides;
- each $n_p'$ and $n_q'$ independently represent an overhang nucleotide;
- wherein $N_b'$ and Y' do not have the same modification; and
- X'X'X', Y'Y'Y', and Z'Z'Z' each independently represent one of three identical modification on three consecutive nucleotides.

In some embodiments, the $N_a'$ and/or $N_b'$ comprise modification of alternating pattern.

The Y'Y'Y' motif occurs at or near the cleavage site of the antisense strand. For example, when the RNAi agent has a duplex region of 17-23 nucleotides in length, the Y'Y'Y' motif can occur at positions 9, 10, 11; 10, 11, 12; 11, 12, 13; 12, 13, 14; or 13, 14, 15 of the antisense strand, with the count starting from the $1^{st}$ nucleotide, from the 5'-end; or optionally, the count starting at the $1^{st}$ paired nucleotide within the duplex region, from the 5'-end. In some embodiments, the Y'Y'Y' motif occurs at positions 11, 12, 13.

In some embodiments, Y'Y'Y' motif is all 2'-Ome modified nucleotides.

In on embodiment, k is 1 and l is 0, or k is 0 and l is 1, or both 5 k and l are 1.

The antisense strand can therefore be represented by the following formulas:

$$5'n_q'\text{-}N_a'\text{—}Z'Z'Z'\text{—}N_b'\text{—}Y'Y'Y'\text{—}N_a'\text{-}n_p'3' \quad \text{(IIb);}$$

$$5'n_q'\text{-}N_a'\text{—}Y'Y'Y'\text{—}N_b'\text{—}X'X'X'\text{-}n_p'3' \quad \text{(IIc); or}$$

$$5'n_q'\text{-}N_a'\text{—}Z'Z'Z'\text{—}N_b'\text{—}Y'Y'Y'\text{—}N_b'\text{—}X'X'X'\text{—}N_a'\text{-}n_p'3' \quad \text{(IId).}$$

When the antisense strand is represented by formula (IIb), $N_b'$ represents an oligonucleotide sequence comprising 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-5, 0-4, 0-2 or 0 modified nucleotides. Each $N_a'$ independently represents an oligonucleotide sequence comprising 2-20, 2-15, or 2-10 modified nucleotides. In some embodiments, $N_b$ is 0, 1, 2, 3, 4, 5 or 6.

In other embodiments, k is 0 and l is 0 and the antisense strand may be represented by the formula:

$$5'n_p'\text{-}N_a'\text{—}Y'Y'Y'\text{—}N_a'\text{-}n_q'3' \quad \text{(Ia).}$$

When the antisense strand is represented as formula (IIa), each $N_a'$ independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, HNA, CeNA, GNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In some embodiments, the sense strand of the RNAi agent may contain YYY motif occurring at 9, 10 and 11 positions of the strand when the duplex region is 21 nt, the count starting from the $1^{st}$ nucleotide from the 5'-end, or optionally, the count starting at the $1^{st}$ paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In some embodiments the antisense strand may Y'Y'Y' motif occurring at positions 11, 12, 13 of the strand, the count starting from the $1^{st}$ nucleotide from the 5'-end, or optionally, the count starting at the $1^{st}$ paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with an antisense strand being represented by any one of formulas (IIa), (IIb), (IIc), and (IId), respectively.

Accordingly, certain RNAi agents for use in the methods of the disclosure may comprise a sense strand and an antisense strand, each strand having 14 to 30 nucleotides, the RNAi duplex represented by formula (III):

$$\text{sense: } 5'n_p\text{-}N_a\text{—}(XXX)_i\text{—}N_b\text{—}YYY\text{—}N_b\text{—}(ZZZ)_j\text{—}N_a\text{-}n_q3'$$

$$\text{antisense: } 3'n_p'\text{-}N_a'\text{—}(X'X'X')_k\text{—}N_b'\text{—}Y'Y'Y'\text{—}N_b'\text{—}(Z'Z'Z')_l\text{—}N_a'\text{-}n_q'5' \quad \text{(III)}$$

wherein, i, j, k, and l are each independently 0 or 1;

p, p', q, and q' are each independently 0-6;

each $N_a$ and $N_a'$ independently represents an oligonucleotide sequence comprising 0-25 modified nucleotides, each sequence comprising at least two differently modified nucleotides;

each $N_b$ and $N_b'$ independently represents an oligonucleotide sequence comprising 0-10 modified nucleotides; wherein each $n_p'$, $n_p$, $n_q'$, and $n_q$, each of which may or may not be present independently represents an overhang nucleotide; and XXX, YYY, ZZZ, X'X'X', Y'Y'Y', and Z'Z'Z' each independently represent one motif of three identical modification on three consecutive nucleotides.

In some embodiments, i is 0 and j is 0; or i is 1 and j is 0; or i is 0 and j is 1; or both i and j are 0; or both i and j are 1. In some embodiments, k is 0 and l is 0; or k is 1 and l is 0; k is 0 and l is 1; or both k and l are 0; or both k and l are 1.

Exemplary combinations of the sense strand and antisense strand forming a RNAi duplex include the formulas below:

$$5'n_p\text{-}N_a\text{—}YYY\text{—}N_a\text{-}n_q3'$$

$$3'n_p'\text{-}N_a'\text{—}Y'Y'Y'\text{—}N_a'n_q'5' \quad \text{(IIIa)}$$

$$5'n_p\text{-}N_a\text{-}YYY\text{-}N_b\text{-}ZZZ\text{-}N_a\text{-}n_q3'$$

$$3'n_p'\text{-}N_a'\text{—}Y'Y'Y'\text{—}N_b'\text{—}Z'Z'Z'\text{—}N_a'\text{-}n_q'5' \quad \text{(IIIb)}$$

$$5'n_p\text{-}N_a\text{—}XXX\text{—}N_b\text{—}YYY\text{—}N_a\text{-}n_q3'$$

$$3'n_p'\text{-}N_a'\text{—}X'X'X'\text{—}N_b'\text{—}Y'Y'Y'\text{—}N_a'\text{-}n_q'5' \quad \text{(IIIc)}$$

$$5'n_p\text{-}N_a\text{—}XXX\text{—}N_b\text{—}YYY\text{—}N_b\text{—}ZZZ\text{—}N_a\text{-}n_q3'$$

$$3'n_p'\text{-}N_a'\text{—}X'X'X'\text{—}N_b'\text{—}Y'Y'Y'\text{—}N_b'\text{—}Z'Z'Z'\text{—}N_a'\text{-}n_q'5' \quad \text{(IIId)}$$

When the RNAi agent is represented by formula (IIIa), each $N_a$ independently represents an oligonucleotide sequence comprising 2-20, 2-15, or 2-10 modified nucleotides.

When the RNAi agent is represented by formula (IIIb), each $N_b$ independently represents an oligonucleotide sequence comprising 1-10, 1-7, 1-5 or 1-4 modified nucleotides. Each $N_a$ independently represents an oligonucleotide sequence comprising 2-20, 2-15, or 2-10 modified nucleotides.

When the RNAi agent is represented as formula (IIIc), each $N_b$, $N_b'$ independently represents an oligonucleotide sequence comprising 0-10, 0-7, 0-5, 0-4, 0-2 or 0 modified nucleotides. Each $N_a$ independently represents an oligonucleotide sequence comprising 2-20, 2-15, or 2-10 modified nucleotides.

When the RNAi agent is represented as formula (IIId), each $N_b$, $N_b'$ independently represents an oligonucleotide sequence comprising 0-10, 0-7, 0-5, 0-4, 0-2 or 0 modified nucleotides. Each $N_a$, $N_a'$ independently represents an oligonucleotide sequence comprising 2-20, 2-15, or 2-10 modified nucleotides. Each of $N_a$, $N_a'$, $N_b$ and $N_b'$ independently comprises modifications of alternating pattern.

Each of X, Y and Z in formulas (III), (IIIa), (IIIb), (IIIc), and (IIId) may be the same or different from each other.

When the RNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the RNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the RNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In some embodiments, the modification on the Y nucleotide is different than the modification on the Y' nucleotide, the modification on the Z nucleotide is different than the modification on the Z' nucleotide, and/or the modification on the X nucleotide is different than the modification on the X' nucleotide.

In some embodiments, when the RNAi agent is represented by formula (IIId), the $N_a$ modifications are 2'-O-methyl or 2'-fluoro modifications. In some embodiments, when the RNAi agent is represented by formula (IIId), the $N_a$ modifications are 2'-O-methyl or 2'-fluoro modifications and $n_p'>0$ and at least one $n_p'$ is linked to a neighboring nucleotide a via phosphorothioate linkage. In some embodiments, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, and the sense strand is conjugated to one or more moieties or ligands (e.g., one or more lipophilic moieties, optionally one or more C16 moieties, or one or more GalNAc moieties) attached through a bivalent or trivalent branched linker. In some embodiments, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more moieties or ligands (e.g., one or more lipophilic moieties, optionally one or more C16 moieties, or one or more GalNAc moieties) attached through a bivalent or trivalent branched linker.

In some embodiments, when the RNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more moieties or ligands (e.g., one or more lipophilic moieties, optionally one or more C16 moieties, or one or more GalNAc moieties) attached through a bivalent or trivalent branched linker.

In some embodiments, the RNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In some embodiments, the RNAi agent is a multimer containing three, four, five, six or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In some embodiments, two RNAi agents represented by formula (III), (IIIa), (IIIb), (IIIc), and (IIId) are linked to each other at the 5' end, and one or both of the 3' ends and are optionally conjugated to a ligand. Each of the agents can target the same gene or two different genes; or each of the agents can target same gene at two different target sites.

Various publications describe multimeric RNAi agents that can be used in the methods of the disclosure. Such publications include WO2007/091269, WO2010/141511, WO2007/117686, WO2009/014887, and WO2011/031520; and U.S. Pat. No. 7,858,769, the contents of each of which are hereby incorporated herein by reference for the methods provided therein. In certain embodiments, the RNAi agents of the disclosure may include GalNAc ligands.

As described in more detail below, the RNAi agent that contains conjugations of one or more carbohydrate moieties to a RNAi agent can optimize one or more properties of the RNAi agent. In many cases, the carbohydrate moiety will be attached to a modified subunit of the RNAi agent. For example, the ribose sugar of one or more ribonucleotide subunits of a dsRNA agent can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide, and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The RNAi agents may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and decalin; preferably, the acyclic group is selected from serinol backbone or diethanolamine backbone.

In certain specific embodiments, the RNAi agent for use in the methods of the disclosure is an agent selected from the group of agents listed in any one of Tables 2A, 2B, 3A, 3B, 4A, 4B, 5A, 5B, 8A, 8B, 10A, 10B, 12, 13, 14, 18A and 18B. These agents may further comprise a ligand. The ligand can be attached to the sense strand, antisense strand or both strands, at the 3'-end, 5'-end, or both ends. For instance, the ligand may be conjugated to the sense strand, in particular, the 3'-end of the sense strand.

iRNA Conjugates

The iRNA agents disclosed herein can be in the form of conjugates. The conjugate may be attached at any suitable location in the iRNA molecule, e.g., at the 3' end or the 5' end of the sense or the antisense strand. The conjugates are optionally attached via a linker.

In some embodiments, an iRNA agent described herein is chemically linked to one or more ligands, moieties or conjugates, which may confer functionality, e.g., by affecting (e.g., enhancing) the activity, cellular distribution or cellular uptake of the iRNA. Such moieties include but are not limited to lipid moieties such as a cholesterol moiety (Letsinger et al., *Proc. Natl. Acid. Sci. USA,* 1989, 86: 6553-6556), cholic acid (Manoharan et al., *Biorg. Med. Chem. Let.,* 1994, 4:1053-1060), a thioether, e.g., beryl-S-tritylthiol (Manoharan et al., *Ann. N.Y. Acad. Sci.,* 1992, 660:306-309; Manoharan et al., *Biorg. Med. Chem. Let.,* 1993, 3:2765-2770), a thiocholesterol (Oberhauser et al., *Nucl. Acids Res.,* 1992, 20:533-538), an aliphatic chain, e.g., dodecandiol or undecyl residues (Saison-Behmoaras et al., *EMBO J,* 1991, 10:1111-1118; Kabanov et al., *FEBS Lett.,* 1990, 259:327-330; Svinarchuk et al., *Biochimie,* 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.,* 1995, 36:3651-3654; Shea et al., *Nucl. Acids Res.,* 1990, 18:3777-3783), a polyamine or a polyethylene glycol chain (Manoharan et al., *Nucleosides & Nucleotides,* 1995, 14:969-973), or adamantane acetic acid (Manoharan et al., *Tetrahedron Lett.,* 1995, 36:3651-3654), a palmityl moiety (Mishra et al., *Biochim. Biophys. Acta,* 1995, 1264:229-237), or an octadecylamine or hexylamino-carbonyloxycholesterol moiety (Crooke et al., *J. Pharmacol. Exp. Ther.,* 1996, 277:923-937).

In some embodiments, a ligand alters the distribution, targeting or lifetime of an iRNA agent into which it is incorporated. In some embodiments, a ligand provides an enhanced affinity for a selected target, e.g., molecule, cell or cell type, compartment, e.g., a cellular or organ compartment, tissue, organ or region of the body, as, e.g., compared to a species absent such a ligand. Typical ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolide) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacrylic acid), N-isopropylacrylamide polymers, or polyphosphazine. Examples of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an a helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, or an RGD peptide or RGD peptide mimetic.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g, cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, $[MPEG]_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as an ocular cell. Ligands may also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present disclosure as ligands (e.g. as PK modulating ligands). In addition, aptamers that bind serum components (e.g. serum proteins) are also suitable for use as PK modulating ligands in the embodiments described herein.

Ligand-conjugated oligonucleotides of the disclosure may be synthesized by the use of an oligonucleotide that bears a pendant reactive functionality, such as that derived from the attachment of a linking molecule onto the oligonucleotide (described below). This reactive oligonucleotide may be reacted directly with commercially available ligands, ligands that are synthesized bearing any of a variety of protecting groups, or ligands that have a linking moiety attached thereto.

The oligonucleotides used in the conjugates of the present disclosure may be conveniently and routinely made through the well-known technique of solid-phase synthesis. Equipment for such synthesis is sold by several vendors including, for example, Applied Biosystems (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present disclosure, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present disclosure are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipophilic Moieties

In certain embodiments, the lipophilic moiety is an aliphatic, cyclic such as alicyclic, or polycyclic such as polyalicyclic compound, such as a steroid (e.g., sterol) or a linear or branched aliphatic hydrocarbon. The lipophilic moiety may generally comprise a hydrocarbon chain, which may be cyclic or acyclic. The hydrocarbon chain may comprise various substituents or one or more heteroatoms, such as an oxygen or nitrogen atom. Such lipophilic aliphatic moieties include, without limitation, saturated or unsaturated $C_4$-$C_{30}$ hydrocarbon (e.g., $C_6$-$C_{18}$ hydrocarbon), saturated or unsaturated fatty acids, waxes (e.g., monohydric alcohol esters of fatty acids and fatty diamides), terpenes (e.g., $C_{10}$ terpenes, $C_{15}$ sesquiterpenes, $C_{20}$ diterpenes, $C_{30}$ triterpenes, and $C_{40}$ tetraterpenes), and other polyalicyclic hydrocarbons. For instance, the lipophilic moiety may contain a $C_4$-$C_{30}$ hydrocarbon chain (e.g., $C_4$-$C_{30}$ alkyl or alkenyl). In some embodiments the lipophilic moiety contains a saturated or unsaturated $C_6$-$C_{18}$ hydrocarbon chain (e.g., a linear $C_6$-$C_{18}$ alkyl or alkenyl). In some embodiments, the lipophilic moiety contains a saturated or unsaturated C16 hydrocarbon chain (e.g., a linear C16 alkyl or alkenyl).

The lipophilic moiety may be attached to the RNAi agent by any method known in the art, including via a functional grouping already present in the lipophilic moiety or introduced into the RNAi agent, such as a hydroxy group (e.g., —CO—$CH_2$—OH). The functional groups already present in the lipophilic moiety or introduced into the RNAi agent include, but are not limited to, hydroxyl, amine, carboxylic acid, sulfonate, phosphate, thiol, azide, and alkyne.

Conjugation of the RNAi agent and the lipophilic moiety may occur, for example, through formation of an ether or a carboxylic or carbamoyl ester linkage between the hydroxy and an alkyl group R—, an alkanoyl group RCO— or a substituted carbamoyl group RNHCO—. The alkyl group R may be cyclic (e.g., cyclohexyl) or acyclic (e.g., straight-chained or branched; and saturated or unsaturated). Alkyl group R may be a butyl, pentyl, hexyl, heptyl, octyl, nonyl, decyl, undecyl, dodecyl, tridecyl, tetradecyl, pentadecyl, hexadecyl, heptadecyl or octadecyl group, or the like.

In some embodiments, the lipophilic moiety is conjugated to the double-stranded RNAi agent via a linker a linker containing an ether, thioether, urea, carbonate, amine, amide, maleimide-thioether, disulfide, phosphodiester, sulfonamide linkage, a product of a click reaction (e.g., a triazole from the azide-alkyne cycloaddition), or carbamate.

In another embodiment, the lipophilic moiety is a steroid, such as sterol. Steroids are polycyclic compounds containing a perhydro-1,2-cyclopentanophenanthrene ring system. Steroids include, without limitation, bile acids (e.g., cholic acid, deoxycholic acid and dehydrocholic acid), cortisone, digoxigenin, testosterone, cholesterol, and cationic steroids, such as cortisone. A "cholesterol derivative" refers to a compound derived from cholesterol, for example by substitution, addition or removal of substituents.

In another embodiment, the lipophilic moiety is an aromatic moiety. In this context, the term "aromatic" refers broadly to mono- and polyaromatic hydrocarbons. Aromatic groups include, without limitation, $C_6$-$C_{14}$ aryl moieties comprising one to three aromatic rings, which may be optionally substituted; "aralkyl" or "arylalkyl" groups comprising an aryl group covalently linked to an alkyl group, either of which may independently be optionally substituted or unsubstituted; and "heteroaryl" groups. As used herein, the term "heteroaryl" refers to groups having 5 to 14 ring atoms, preferably 5, 6, 9, or 10 ring atoms; having 6, 10, or 14n electrons shared in a cyclic array, and having, in addition to carbon atoms, one to about three heteroatoms selected from the group consisting of nitrogen (N), oxygen (O), and sulfur (S).

As employed herein, a "substituted" alkyl, cycloalkyl, aryl, heteroaryl, or heterocyclic group is one having one to about four, preferably one to about three, more preferably one or two, non-hydrogen substituents. Suitable substituents include, without limitation, halo, hydroxy, nitro, haloalkyl, alkyl, alkaryl, aryl, aralkyl, alkoxy, aryloxy, amino, acylamino, alkylcarbamoyl, arylcarbamoyl, aminoalkyl, alkoxycarbonyl, carboxy, hydroxyalkyl, alkanesulfonyl, arenesulfonyl, alkanesulfonamido, arenesulfonamido, aralkylsulfonamido, alkylcarbonyl, acyloxy, cyano, and ureido groups.

In some embodiments, the lipophilic moiety is an aralkyl group, e.g., a 2-arylpropanoyl moiety. The structural features of the aralkyl group are selected so that the lipophilic moiety will bind to at least one protein in vivo. In certain embodiments, the structural features of the aralkyl group are selected so that the lipophilic moiety binds to serum, vascular, or cellular proteins. In certain embodiments, the structural features of the aralkyl group promote binding to albumin, an immunoglobulin, a lipoprotein, α-2-macroglubulin, or α-1-glycoprotein.

In certain embodiments, the ligand is naproxen or a structural derivative of naproxen. Procedures for the synthesis of naproxen can be found in U.S. Pat. Nos. 3,904,682 and 4,009,197, which are hereby incorporated by reference in their entirety. Naproxen has the chemical name (S)-6-Methoxy-α-methyl-2-naphthaleneacetic acid and the structure is

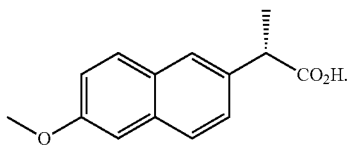 [SMILES: COc1ccc2cc([C@H](C)C(=O)O)ccc2c1]

In certain embodiments, the ligand is ibuprofen or a structural derivative of ibuprofen. Procedures for the synthesis of ibuprofen can be found in U.S. Pat. No. 3,228,831, which is incorporated herein by reference for the methods provided therein. The structure of ibuprofen is

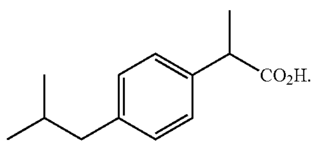

Additional exemplary aralkyl groups are illustrated in U.S. Pat. No. 7,626,014, which is incorporated herein by reference for the methods provided therein.

In another embodiment, suitable lipophilic moieties include lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl)lithocholic acid, O3-(oleoyl)cholenic acid, ibuprofen, naproxen, dimethoxytrityl, or phenoxazine.

In certain embodiments, more than one lipophilic moiety can be incorporated into the double-strand RNAi agent, particularly when the lipophilic moiety has a low lipophilicity or hydrophobicity. In some embodiments, two or more lipophilic moieties are incorporated into the same strand of the double-strand RNAi agent. In some embodiments, each strand of the double-strand RNAi agent has one or more lipophilic moieties incorporated. In some embodiments, two or more lipophilic moieties are incorporated into the same position (i.e., the same nucleobase, same sugar moiety, or same internucleosidic linkage) of the double-strand RNAi agent. This can be achieved by, e.g., conjugating the two or more lipophilic moieties via a carrier, or conjugating the two or more lipophilic moieties via a branched linker, or conjugating the two or more lipophilic moieties via one or more linkers, with one or more linkers linking the lipophilic moieties consecutively.

The lipophilic moiety may be conjugated to the RNAi agent via a direct attachment to the ribosugar of the RNAi agent. Alternatively, the lipophilic moiety may be conjugated to the double-strand RNAi agent via a linker or a carrier.

In certain embodiments, the lipophilic moiety may be conjugated to the RNAi agent via one or more linkers (tethers).

In some embodiments, the lipophilic moiety is conjugated to the double-stranded RNAi agent via a linker containing an ether, thioether, urea, carbonate, amine, amide, maleimide-thioether, disulfide, phosphodiester, sulfonamide linkage, a product of a click reaction (e.g., a triazole from the azide-alkyne cycloaddition), or carbamate.

B. Lipid Conjugates

In some embodiments, the ligand is a lipid or lipid-based molecule. Such a lipid or lipid-based molecule can typically bind a serum protein, such as human serum albumin (HSA). An HSA binding ligand allows for vascular distribution of the conjugate to a target tissue. For example, the target tissue can be the eye. Other molecules that can bind HSA can also be used as ligands. For example, neproxin or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid-based ligand can be used to modulate, e.g., control (e.g., inhibit) the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In some embodiments, the lipid-based ligand binds HSA. For example, the ligand can bind HSA with a sufficient affinity such that distribution of the conjugate to a non-kidney tissue is enhanced. However, the affinity is typically not so strong that the HSA-ligand binding cannot be reversed.

In some embodiments, the lipid-based ligand binds HSA weakly or not at all, such that distribution of the conjugate to the kidney is enhanced. Other moieties that target to kidney cells can also be used in place of or in addition to the lipid-based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by cancer cells. Also included are HSA and low-density lipoprotein (LDL).

Cell Permeation Agents

In another aspect, the ligand is a cell-permeation agent, such as a helical cell-permeation agent. In some embodiments, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is typically an α-helical agent, and can have a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 4158). An RFGF analogue (e.g., amino acid sequence AALLPVLLAAP (SEQ ID NO: 4159)) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 4160)) and the *Drosophila Antennapedia* protein (RQIKIWFQNRRMKWKK (SEQ ID NO: 4161)) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., *Nature,* 354:82-84, 1991). Typically, the peptide or peptidomimetic tethered to a dsRNA agent via an incorporated monomer unit is a cell targeting peptide such as an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the disclosure may be linear or cyclic, and may be modified, e.g., glycosylated or methylated, to facilitate targeting to a specific tissue(s). RGD-containing peptides and peptidomimetics may include D-amino acids, as well as synthetic RGD mimics. In addition to RGD, one can use other moieties that target the integrin ligand. In some embodiments, conjugates of this ligand target PECAM-1 or VEGF.

An RGD peptide moiety can be used to target a particular cell type, e.g., a tumor cell, such as an endothelial tumor cell or a breast cancer tumor cell (Zitzmann et al., *Cancer Res.,* 62:5139-43, 2002). An RGD peptide can facilitate targeting of an dsRNA agent to tumors of a variety of other tissues, including the lung, kidney, spleen, or liver (Aoki et al., *Cancer Gene Therapy* 8:783-787, 2001). Typically, the RGD peptide will facilitate targeting of an iRNA agent to the kidney. The RGD peptide can be linear or cyclic, and can be modified, e.g., glycosylated or methylated to facilitate targeting to specific tissues. For example, a glycosylated RGD peptide can deliver a iRNA agent to a tumor cell expressing $\alpha_v\beta_3$ (Haubner et al., *Jour. Nucl. Med.,* 42:326-336, 2001).

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., *Nucl. Acids Res.* 31:2717-2724, 2003).

Carbohydrate Conjugates and Ligands

In some embodiments of the compositions and methods of the disclosure, an iRNA oligonucleotide further comprises a carbohydrate. The carbohydrate conjugated iRNA are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In certain embodiments, the compositions and methods of the disclosure include a C16 ligand. In exemplary embodiments, the C16 ligand of the disclosure has the following structure (exemplified here below for a uracil base, yet attachment of the C16 ligand is contemplated for a nucleotide presenting any base (C, G, A, etc.) or possessing any other modification as presented herein, provided that 2' ribo attachment is preserved) and is attached at the 2' position of the ribo within a residue that is so modified:

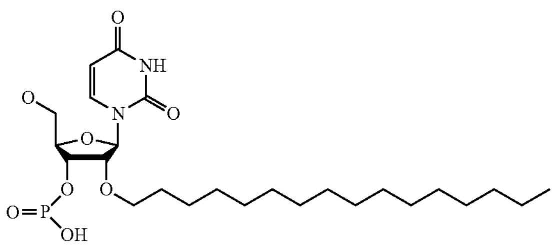

Chemical Formula: $C_{25}H_{43}N_2O_8P$
Exact Mass: 530.2757
Molecular Weight: 530.5913

As shown above, a C16 ligand-modified residue presents a straight chain alkyl at the 2'-ribo position of an exemplary residue (here, a Uracil) that is so modified.

In some embodiments, a carbohydrate conjugate of a RNAi agent of the instant disclosure further comprises one or more additional ligands as described above, such as, but not limited to, a PK modulator or a cell permeation peptide.

Additional carbohydrate conjugates (and linkers) suitable for use in the present disclosure include those described in WO 2014/179620 and WO 2014/179627, the entire contents of each of which are incorporated herein by reference.

In certain embodiments, the compositions and methods of the disclosure include a vinyl phosponate (VP) modification of an RNAi agent as described herein. In exemplary embodiments, a vinyl phosphonate of the disclosure has the following structure:

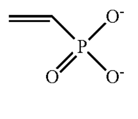

A vinyl phosponate of the instant disclosure may be attached to either the antisense or the sense strand of a dsRNA of the disclosure. In certain preferred embodiments, a vinyl phosphonate of the instant disclosure is attached to the antisense strand of a dsRNA, optionally at the 5' end of the antisense strand of the dsRNA.

Vinyl phosphate modifications are also contemplated for the compositions and methods of the instant disclosure. An exemplary vinyl phosphate structure is:

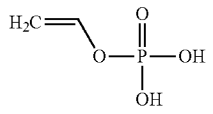

In some embodiments, a carbohydrate conjugate comprises a monosaccharide. In some embodiments, the monosaccharide is an N-acetylgalactosamine (GalNAc). GalNAc conjugates, which comprise one or more N-acetylgalactosamine (GalNAc) derivatives, are described, for example, in U.S. Pat. No. 8,106,022, the entire content of which is hereby incorporated herein by reference. In some embodiments, the GalNAc conjugate serves as a ligand that targets the iRNA to particular cells. In some embodiments, the GalNAc conjugate targets the iRNA to liver cells, e.g., by serving as a ligand for the asialoglycoprotein receptor of liver cells (e.g., hepatocytes).

In some embodiments, the carbohydrate conjugate comprises one or more GalNAc derivatives. The GalNAc derivatives may be attached via a linker, e.g., a bivalent or trivalent branched linker. In some embodiments the GalNAc conjugate is conjugated to the 3' end of the sense strand. In some embodiments, the GalNAc conjugate is conjugated to the iRNA agent (e.g., to the 3' end of the sense strand) via a linker, e.g., a linker as described herein.

In some embodiments, the GalNAc conjugate is
Formula II
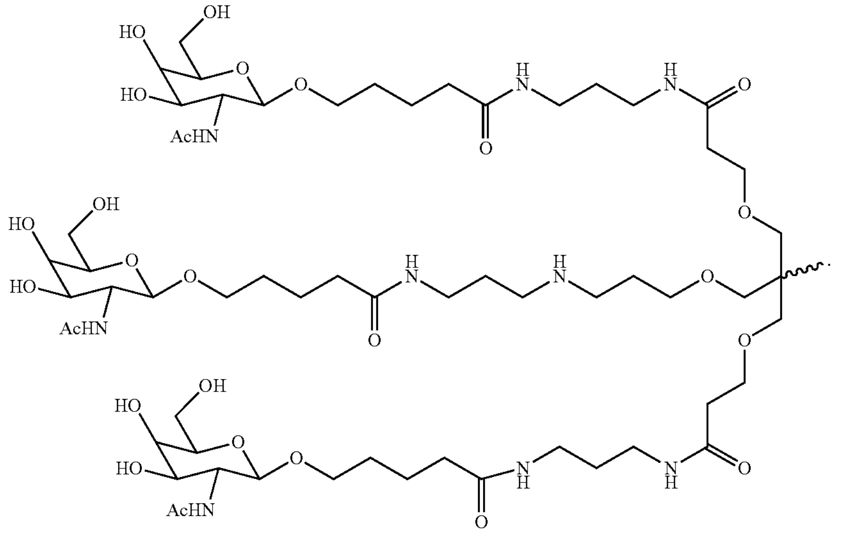
In some embodiments, the RNAi agent is attached to the carbohydrate conjugate via a linker as shown in the following schematic, wherein X is O or S:
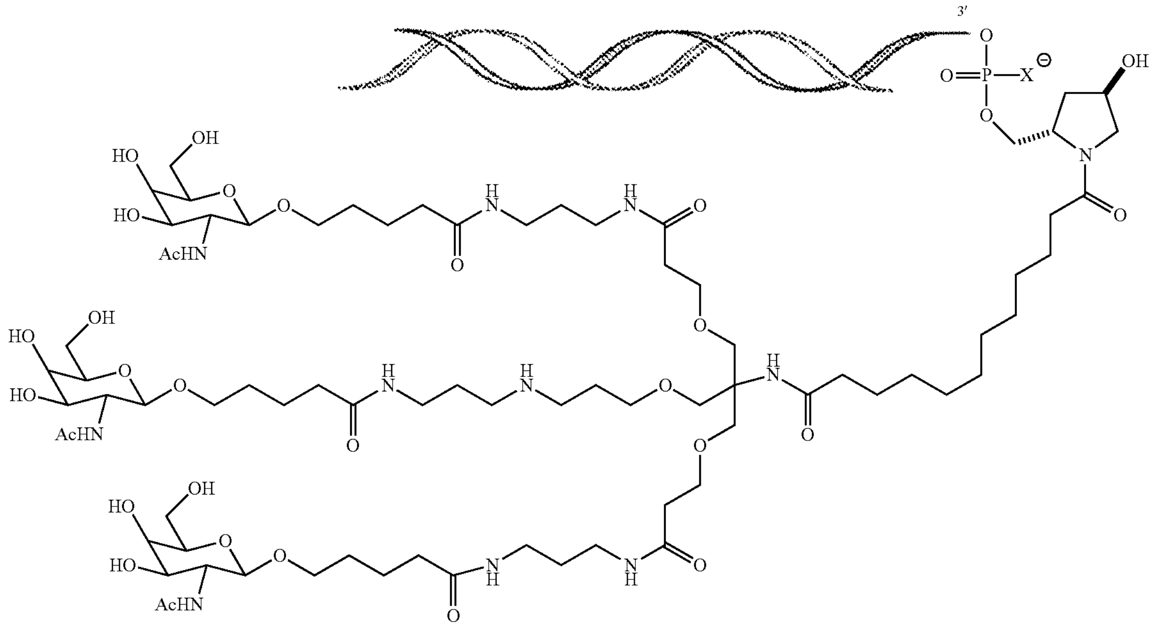

In some embodiments, the RNAi agent is conjugated to L96 as defined in Table 1 and shown below:
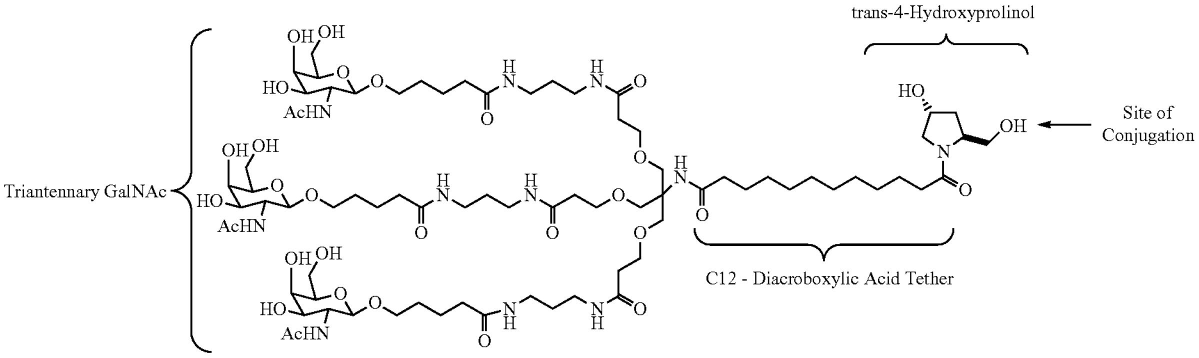
In some embodiments, a carbohydrate conjugate for use in the compositions and methods of the disclosure is selected from the group consisting of:
Formula II
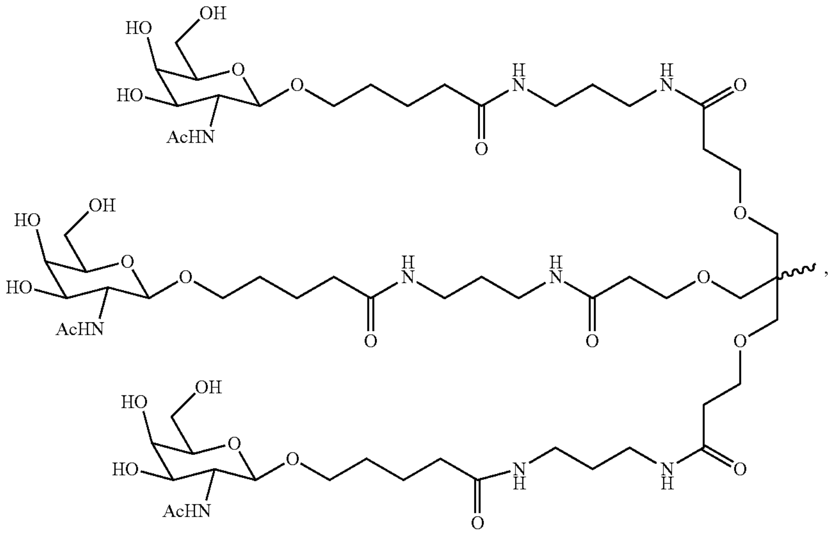
Formula III
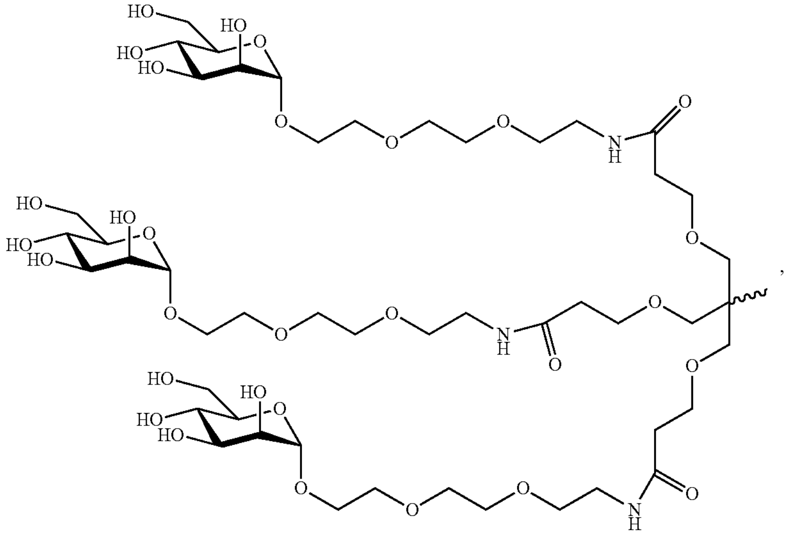

-continued
Formula IV
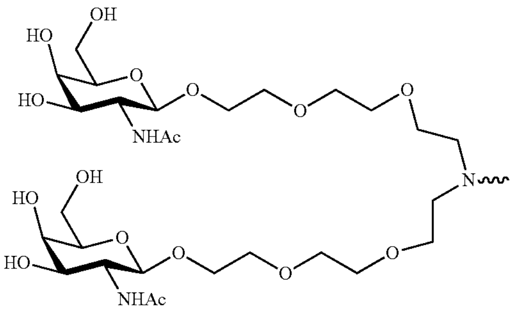
,
Formula V
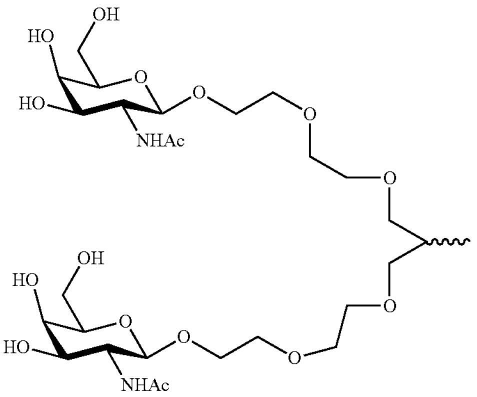
,
Formula VI
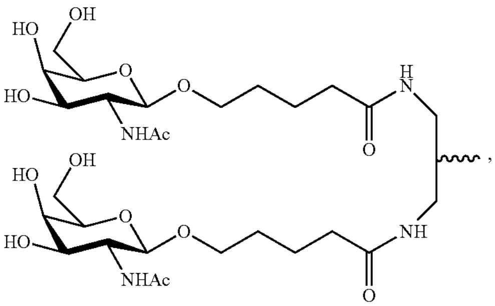
,
Formula VII
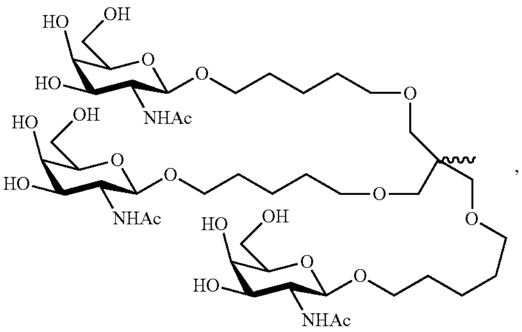
,
Formula VIII
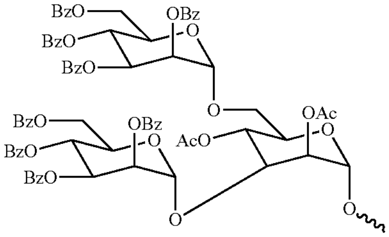
,
Formula IX
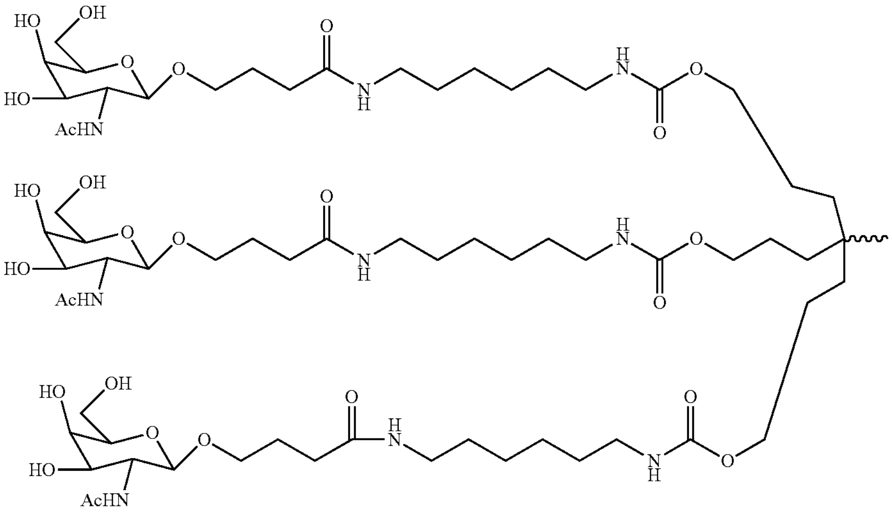
, -continued
Formula X
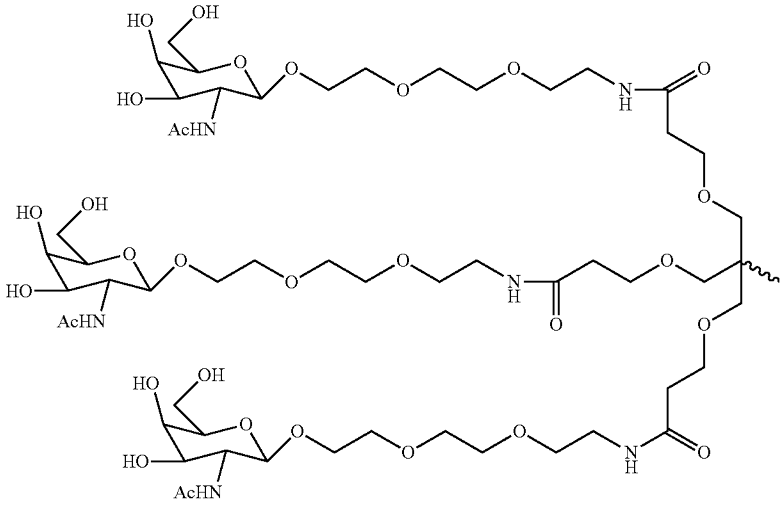
,
Formula XI
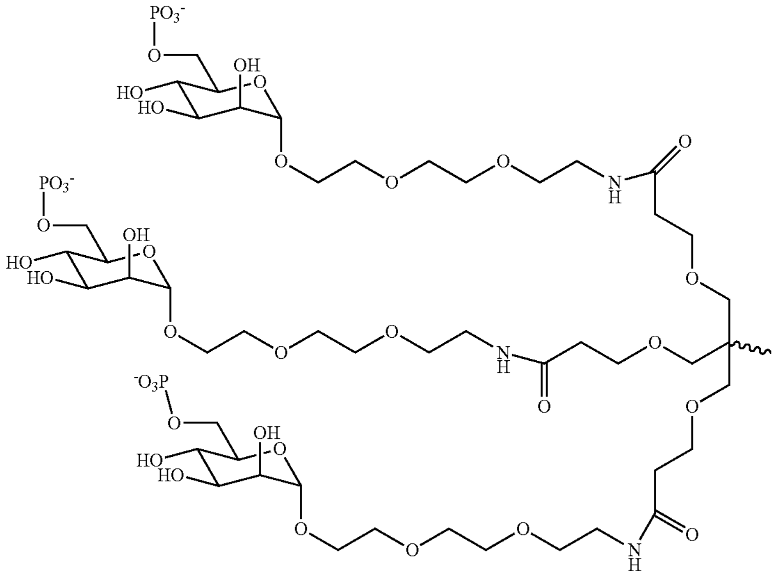
, -continued
Formula XII
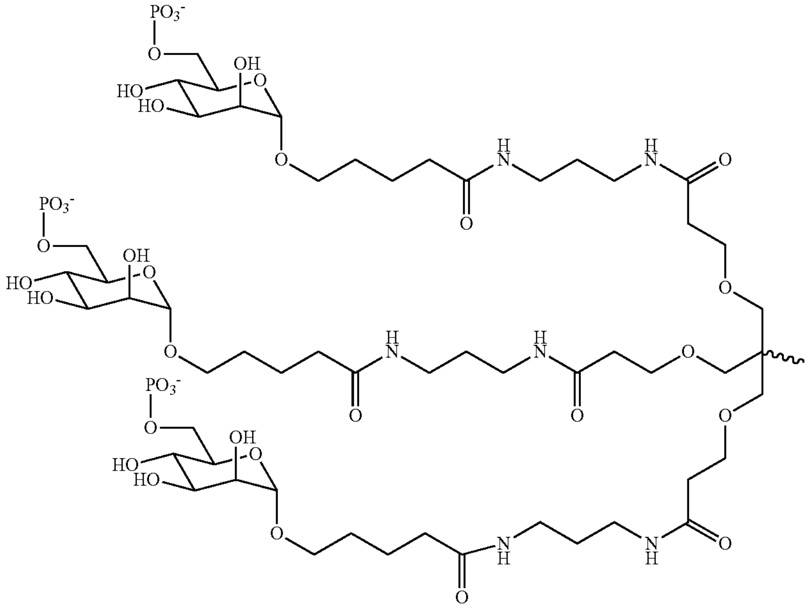
,
Formula XII
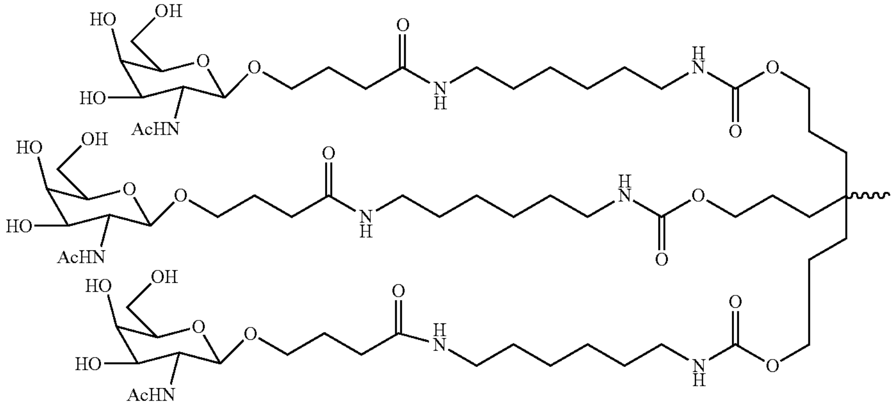
,
Formula XIV
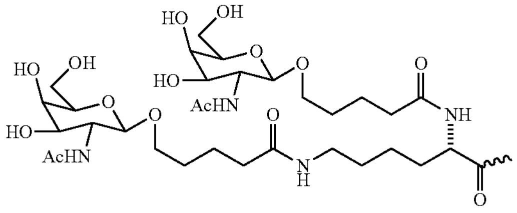
,
Formula XV
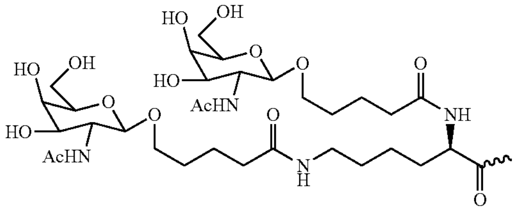
,
Formula XVI
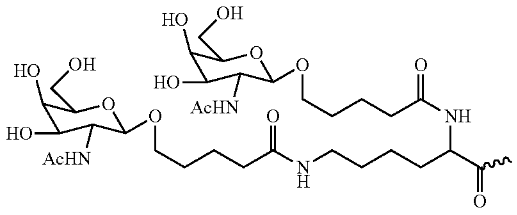
,
Formula XVII
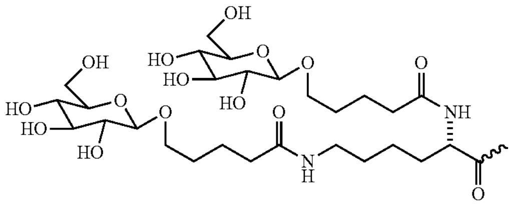
, -continued
Formula XVIII
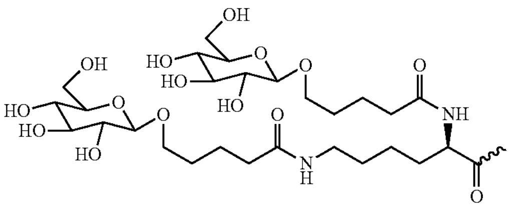
,
Formula XIX
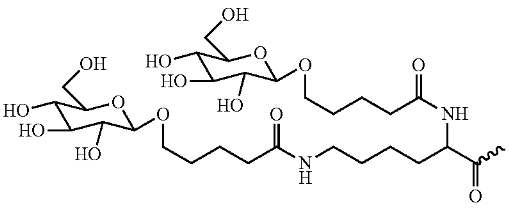
,
Formula XX
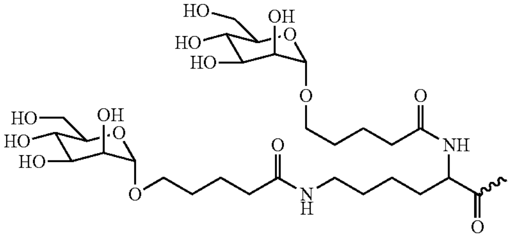
,
Formula XXI
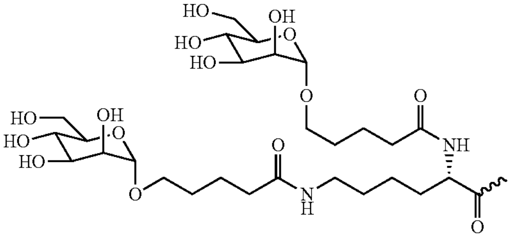
,
Formula XXII
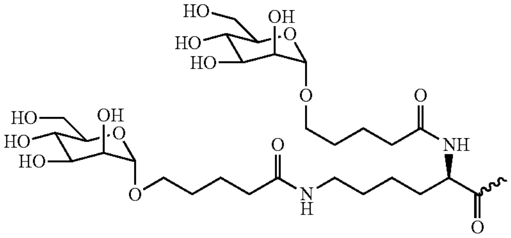
.
Another representative carbohydrate conjugate for use in the embodiments described herein includes, but is not limited to,
(Formula XXIII)
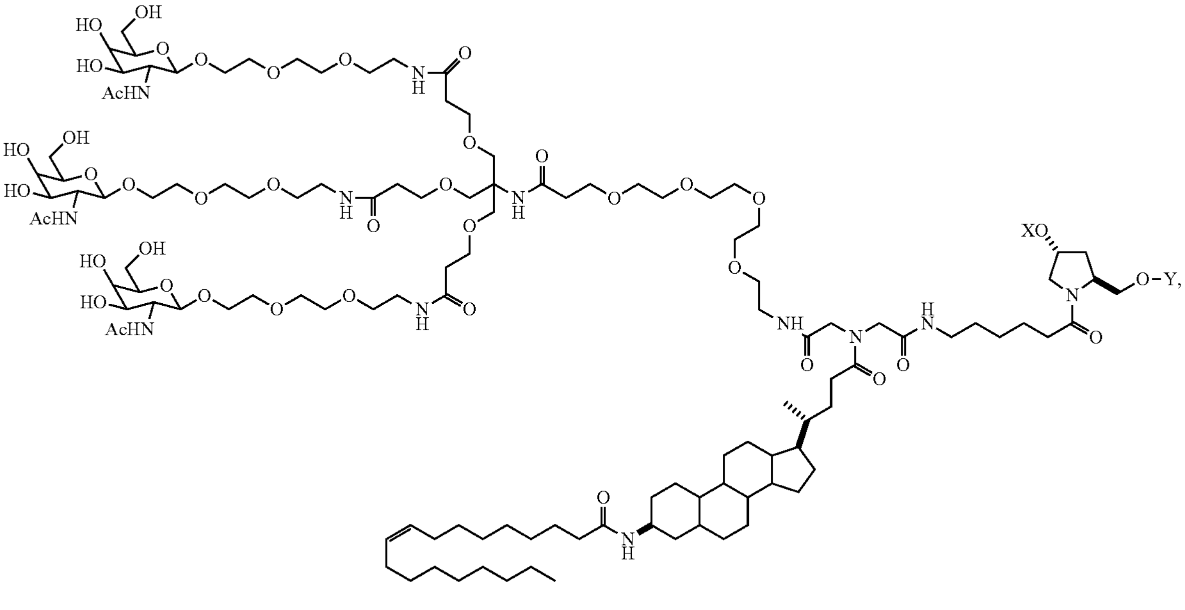

when one of X or Y is an oligonucleotide, the other is a hydrogen.

In some embodiments, the carbohydrate conjugate further comprises one or more additional ligands as described above, such as, but not limited to, a PK modulator and/or a cell permeation peptide.

In some embodiments, an iRNA of the disclosure is conjugated to a carbohydrate through a linker. Non-limiting examples of iRNA carbohydrate conjugates with linkers of the compositions and methods of the disclosure include, but are not limited to, (Formula XXIV)

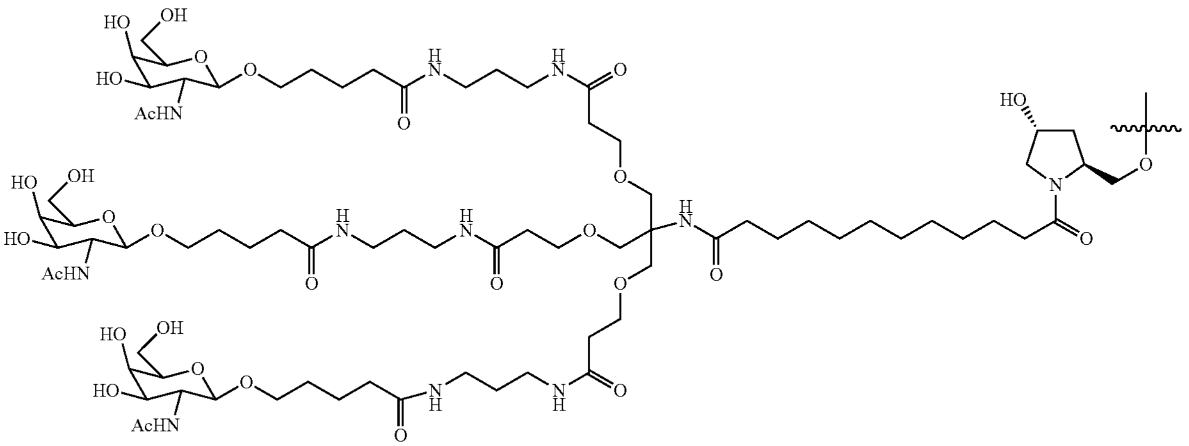

, (Formula XXV)

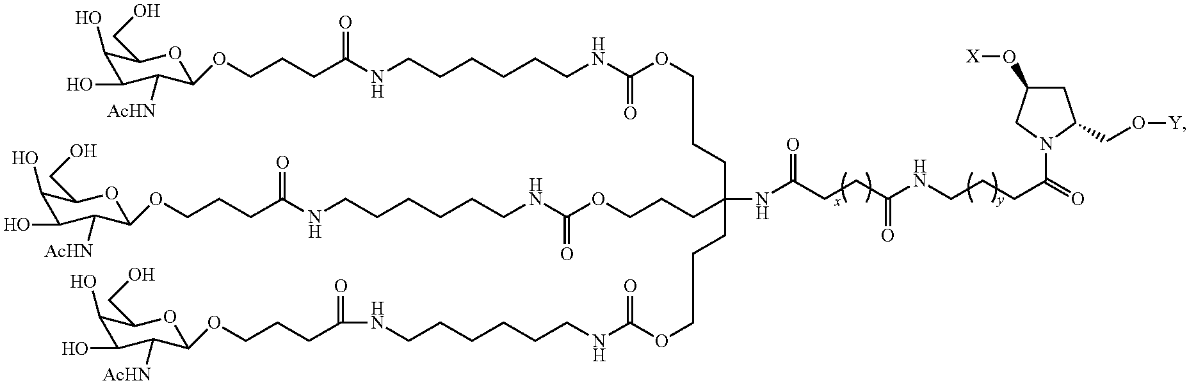

x = 1-30
y = 1-15

(Formula XXVI)

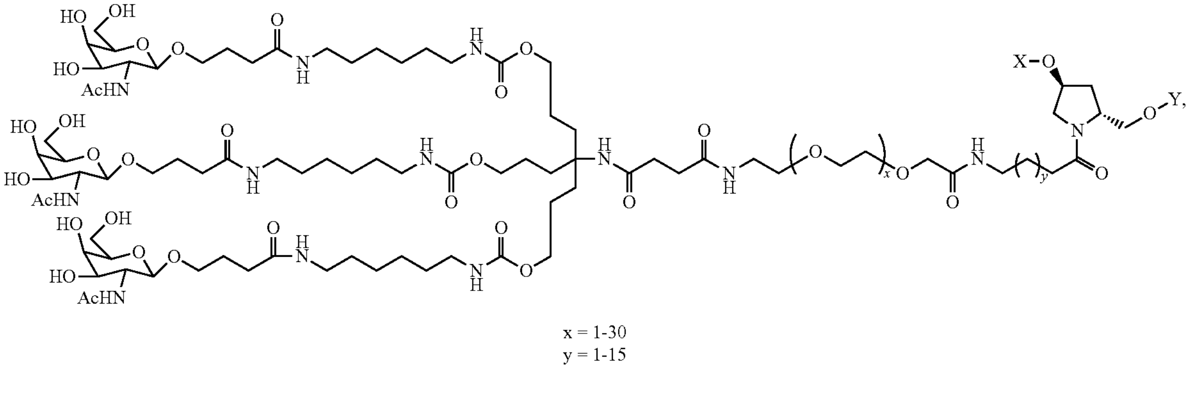

x = 1-30
y = 1-15

-continued
(Formula XXVII)
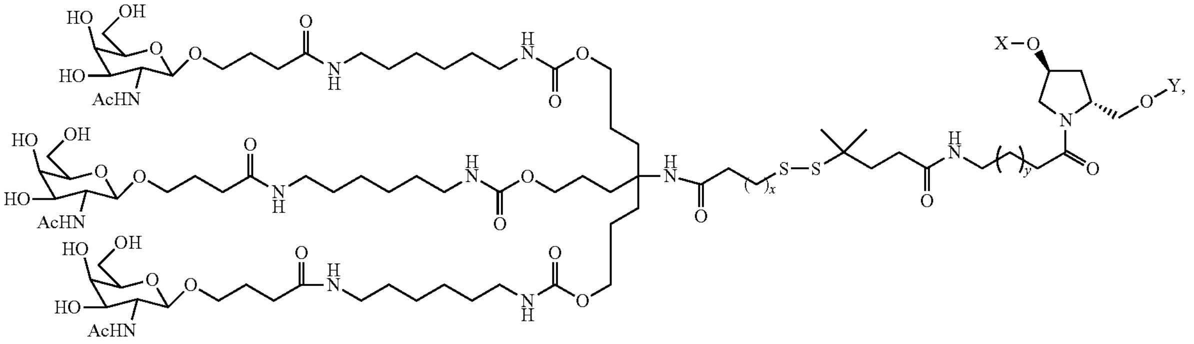
x = 0-30
y = 1-15
(Formula XXVIII)
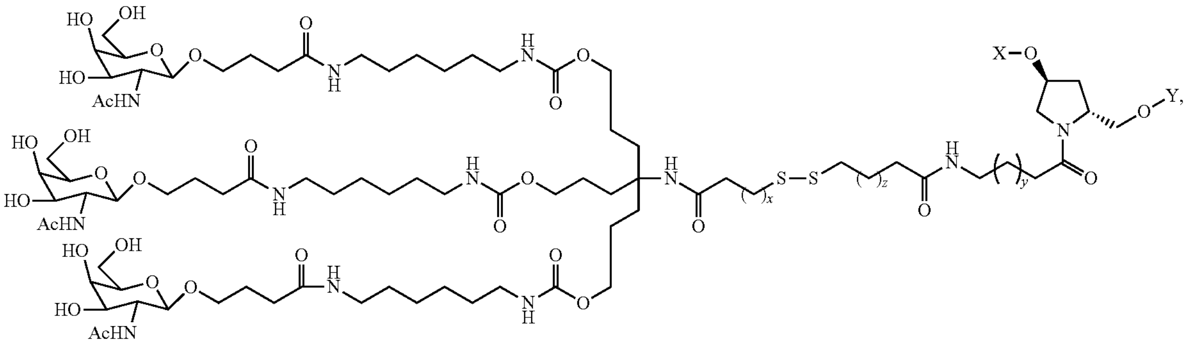
x = 0-30
y = 1-15
z = 1-20
(Formula XXIX)
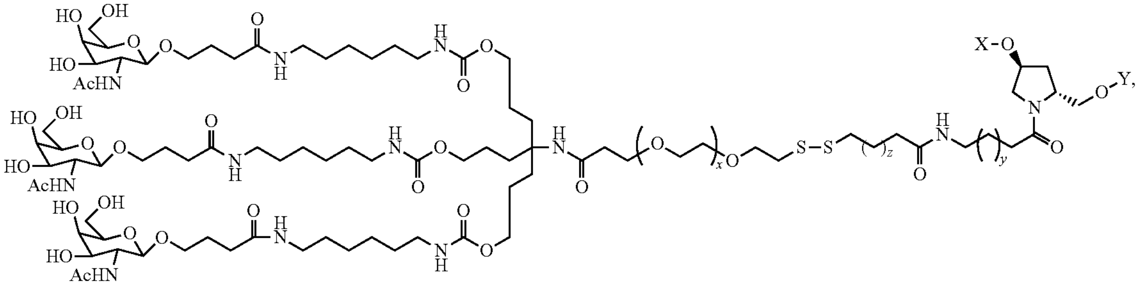
and
x = 1-30
y = 1-15
z = 1-20

-continued (Formula XXX)

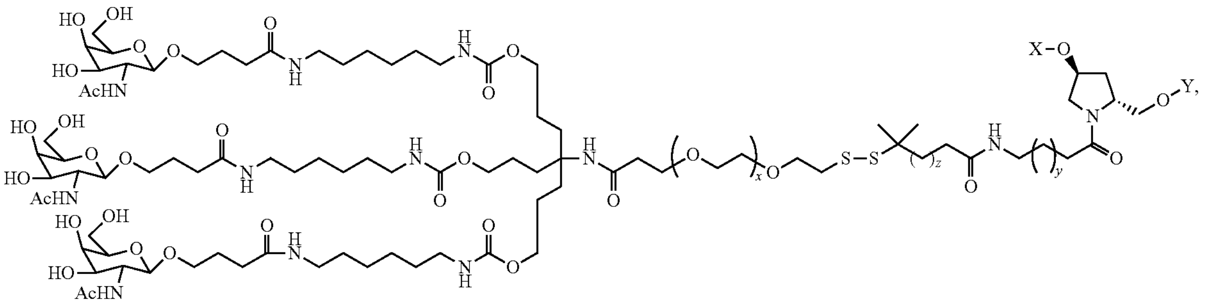

x = 1-30
y = 1-15
z = 1-20 when one of X or Y is an oligonucleotide, the other is a hydrogen.

E. Thermally Destabilizing Modifications

In certain embodiments, a dsRNA molecule can be optimized for RNA interference by incorporating thermally destabilizing modifications in the seed region of the antisense strand (i.e., at positions 2-9 of the 5'-end of the antisense strand) to reduce or inhibit off-target gene silencing. It has been discovered that dsRNAs with an antisense strand comprising at least one thermally destabilizing modification of the duplex within the first 9 nucleotide positions, counting from the 5' end, of the antisense strand have reduced off-target gene silencing activity. Accordingly, in some embodiments, the antisense strand comprises at least one (e.g., one, two, three, four, five, or more) thermally destabilizing modification of the duplex within the first 9 nucleotide positions of the 5' region of the antisense strand. In some embodiments, one or more thermally destabilizing modification(s) of the duplex is/are located in positions 2-9, or preferably positions 4-8, from the 5'-end of the antisense strand. In some further embodiments, the thermally destabilizing modification(s) of the duplex is/are located at position 6, 7, or 8 from the 5'-end of the antisense strand. In still some further embodiments, the thermally destabilizing modification of the duplex is located at position 7 from the 5'-end of the antisense strand. The term "thermally destabilizing modification(s)" includes modification(s) that would result with a dsRNA with a lower overall melting temperature (Tm) (preferably a Tm with one, two, three, or four degrees lower than the Tm of the dsRNA without having such modification(s). In some embodiments, the thermally destabilizing modification of the duplex is located at position 2, 3, 4, 5, or 9 from the 5'-end of the antisense strand.

The thermally destabilizing modifications can include, but are not limited to, abasic modification; mismatch with the opposing nucleotide in the opposing strand; and sugar modification such as 2'-deoxy modification or acyclic nucleotide, e.g., unlocked nucleic acids (UNA) or glycol nucleic acid (GNA).

Exemplified abasic modifications include, but are not limited to, the following:

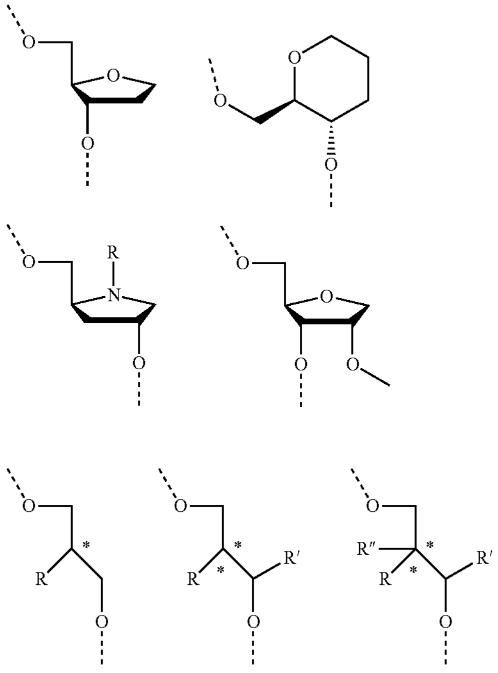

Wherein R=H, Me, Et or OMe; R'=H, Me, Et or OMe; R"=H, Me, Et or OMe

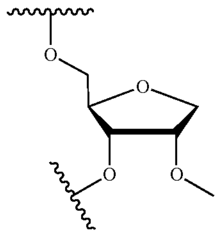

Mod2
(2'-OMe Abasic
Spacer)

-continued

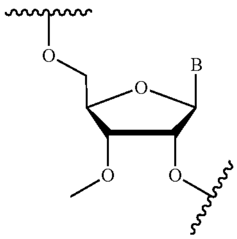

Mod3
(3'-OMe)

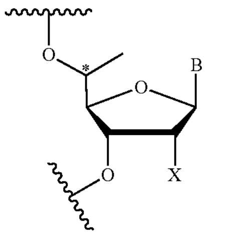

Mod4
(5'-Me)
X = OMe, F

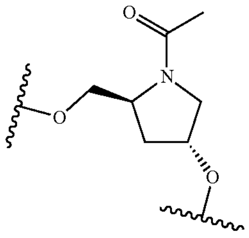

Mod5
(Hyp-spacer)

wherein B is a modified or unmodified nucleobase.

Exemplified sugar modifications include, but are not limited to the following:

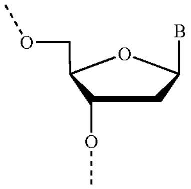

2'-deoxy

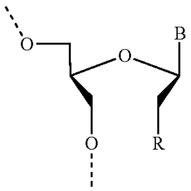

unlocked nucleic acid
R= H, OH, O-alkyl

-continued

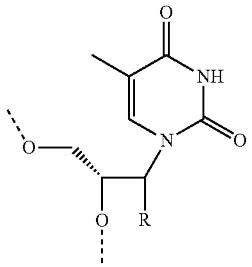

glycol nucleic acid
R= H, OH, O-alkyl

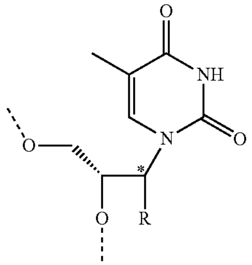

glycol nucleic acid
R= H, OH, O-alkyl

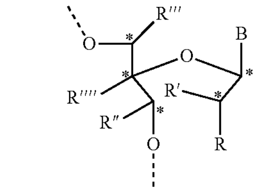

unlocked nucleic acid
R= H, OH, $CH_3$, $CH_2CH_3$, O-alkyl, $NH_2$, NHMe, $NMe_2$
R'= H, OH, $CH_3$, $CH_2CH_3$, O-alkyl, $NH_2$, NHMe, $NMe_2$
R''= H, OH, $CH_3$, $CH_2CH_3$, O-alkyl, $NH_2$, NHMe, $NMe_2$
R'''= H, OH, $CH_3$, $CH_2CH_3$, O-alkyl, $NH_2$, NHMe, $NMe_2$
R''''= H, OH, $CH_3$, $CH_2CH_3$, O-alkyl, $NH_2$, NHMe, $NMe_2$

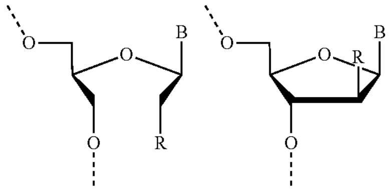

R = H, methyl, ethyl wherein B is a modified or unmodified nucleobase.

In some embodiments the thermally destabilizing modification of the duplex is selected from the group consisting of:

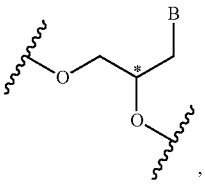
,
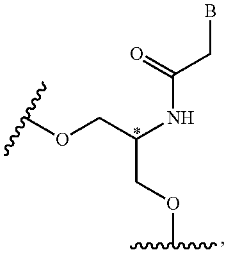
,

-continued

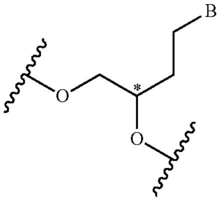
,
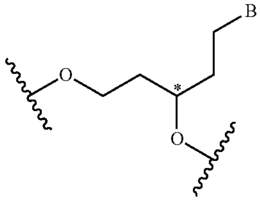
,
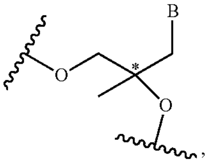
, and
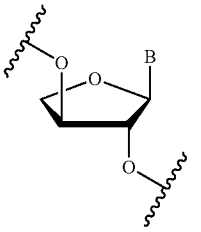

wherein B is a modified or unmodified nucleobase and the asterisk on each structure represents either R, S or racemic.

The term "acyclic nucleotide" refers to any nucleotide having an acyclic ribose sugar, for example, where any of bonds between the ribose carbons (e.g., C1'-C2', C2'-C3', C3'-C4', C4'-O4', or C1'-O4') is absent or at least one of ribose carbons or oxygen (e.g., C1', C2', C3', C4', or O4') are independently or in combination absent from the nucleotide. In some embodiments, acyclic nucleotide is

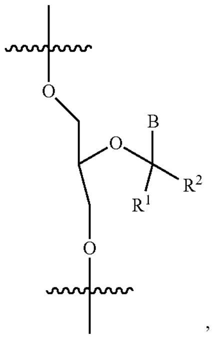
,
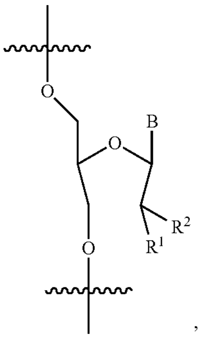
,
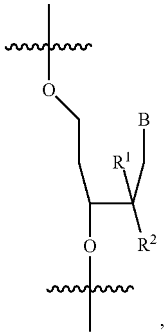
,
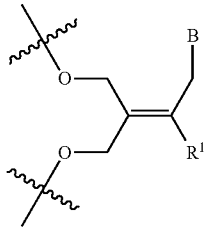
or
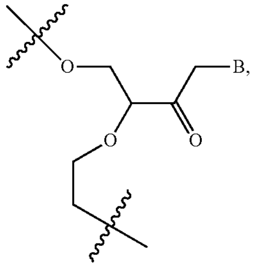

wherein B is a modified or unmodified nucleobase, $R^1$ and $R^2$ independently are H, halogen, $OR_3$, or alkyl; and $R_3$ is H, alkyl, cycloalkyl, aryl, aralkyl, heteroaryl or sugar). The term "UNA" refers to unlocked acyclic nucleic acid, wherein any of the bonds of the sugar has been removed, forming an unlocked "sugar" residue. In one example, UNA also encompasses monomers with bonds between C1'-C4' being removed (i.e. the covalent carbon-oxygen-carbon bond between the C1' and C4' carbons). In another example, the C2'-C3' bond (i.e. the covalent carbon-carbon bond between the C2' and C3' carbons) of the sugar is removed (see Mikhailov et. al., Tetrahedron Letters, 26 (17): 2059 (1985); and Fluiter et al., Mol. Biosyst., 10: 1039 (2009), which are hereby incorporated by reference in their entirety). The acyclic derivative provides greater backbone flexibility without affecting the Watson-Crick pairings. The acyclic nucleotide can be linked via 2'-5' or 3'-5' linkage.

The term 'GNA' refers to glycol nucleic acid which is a polymer similar to DNA or RNA but differing in the composition of its "backbone" in that is composed of repeating glycerol units linked by phosphodiester bonds:

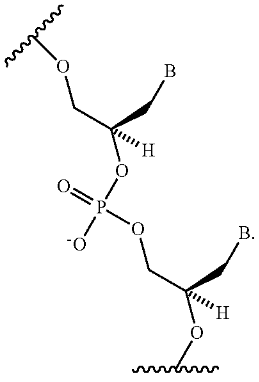

(R)-GNA

The thermally destabilizing modification of the duplex can be mismatches (i.e., noncomplementary base pairs) between the thermally destabilizing nucleotide and the opposing nucleotide in the opposite strand within the dsRNA duplex. Exemplary mismatch base pairs include G:G, G:A, G:U, G:T, A:A, A:C, C:C, C:U, C:T, U:U, T:T, U:T, or a combination thereof. Other mismatch base pairings known in the art are also amenable to the present invention. A mismatch can occur between nucleotides that are either naturally occurring nucleotides or modified nucleotides, i.e., the mismatch base pairing can occur between the nucleobases from respective nucleotides independent of the modifications on the ribose sugars of the nucleotides. In certain embodiments, the dsRNA molecule contains at least one nucleobase in the mismatch pairing that is a 2'-deoxy nucleobase; e.g., the 2'-deoxy nucleobase is in the sense strand.

In some embodiments, the thermally destabilizing modification of the duplex in the seed region of the antisense strand includes nucleotides with impaired W-C H-bonding to complementary base on the target mRNA, such as:

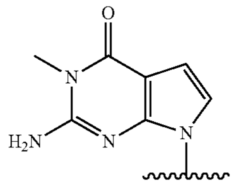
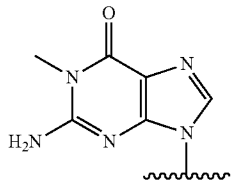
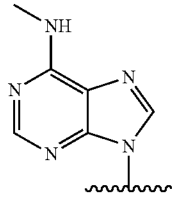
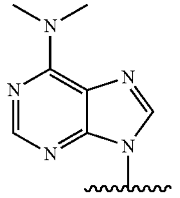
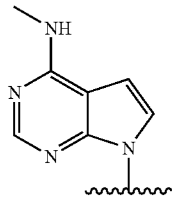
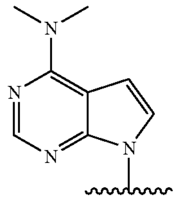
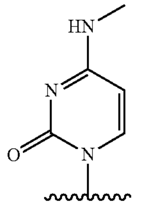
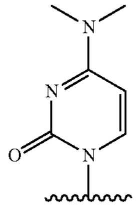
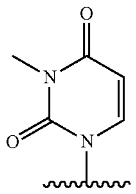
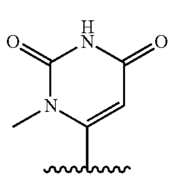
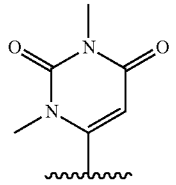
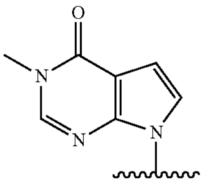
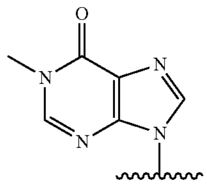
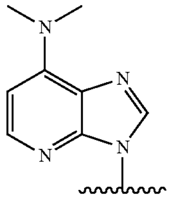
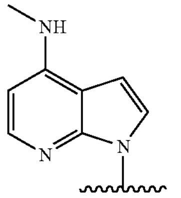
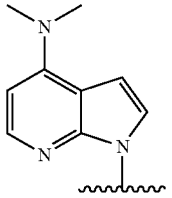
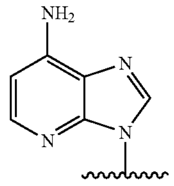
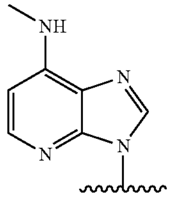
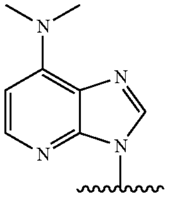

More examples of abasic nucleotide, acyclic nucleotide modifications (including UNA and GNA), and mismatch modifications have been described in detail in WO 2011/133876, which is herein incorporated by reference in its entirety.

The thermally destabilizing modifications may also include universal base with reduced or abolished capability to form hydrogen bonds with the opposing bases, and phosphate modifications.

In some embodiments, the thermally destabilizing modification of the duplex includes nucleotides with non-canonical bases such as, but not limited to, nucleobase modifications with impaired or completely abolished capability to form hydrogen bonds with bases in the opposite strand. These nucleobase modifications have been evaluated for destabilization of the central region of the dsRNA duplex as described in WO 2010/0011895, which is herein incorporated by reference in its entirety. Exemplary nucleobase modifications are:

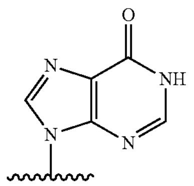

inosine

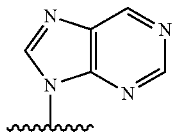

nebularine

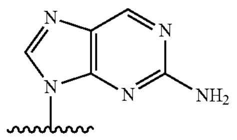

2-aminopurine

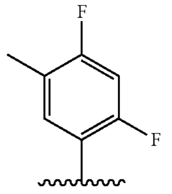

2, 4-difluorotoluene

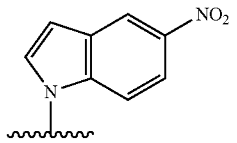

5-nitroindole

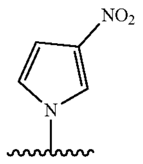

3-nitorpyrrole

-continued

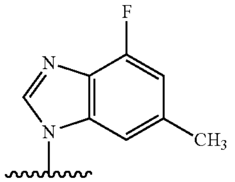

4-Fluoro-6-methylbenzimidazole

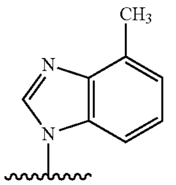

4-Methylbenzimidazole

In some embodiments, the thermally destabilizing modification of the duplex in the seed region of the antisense strand includes one or more α-nucleotide complementary to the base on the target mRNA, such as:

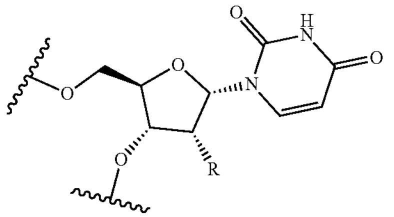

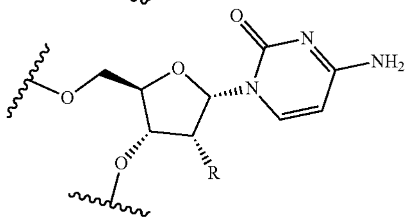

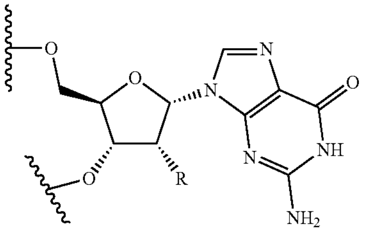

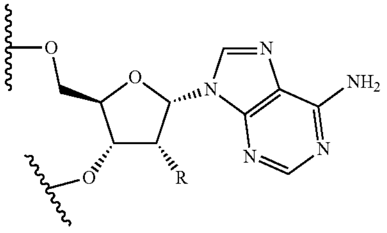

wherein R is H, OH, $OCH_3$, F, $NH_2$, NHMe, $NMe_2$ or O-alkyl.

Exemplary phosphate modifications known to decrease the thermal stability of dsRNA duplexes compared to natural phosphodiester linkages are:

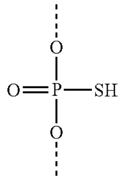

R = alkyl

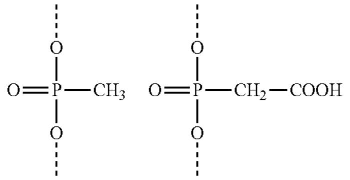

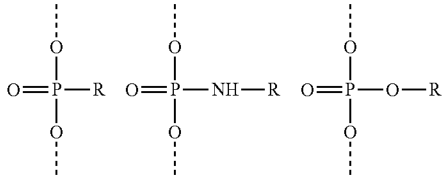

The alkyl for the R group can be a $C_1$-$C_6$alkyl. Specific alkyls for the R group include, but are not limited to methyl, ethyl, propyl, isopropyl, butyl, pentyl and hexyl.

As the skilled artisan will recognize, in view of the functional role of nucleobases is defining specificity of a RNAi agent of the disclosure, while nucleobase modifications can be performed in the various manners as described herein, e.g., to introduce destabilizing modifications into a RNAi agent of the disclosure, e.g., for purpose of enhancing on-target effect relative to off-target effect, the range of modifications available and, in general, present upon RNAi agents of the disclosure tends to be much greater for non-nucleobase modifications, e.g., modifications to sugar groups or phosphate backbones of polyribonucleotides. Such modifications are described in greater detail in other sections of the instant disclosure and are expressly contemplated for RNAi agents of the disclosure, either possessing native nucleobases or modified nucleobases as described above or elsewhere herein.

In addition to the antisense strand comprising a thermally destabilizing modification, the dsRNA can also comprise one or more stabilizing modifications. For example, the dsRNA can comprise at least two (e.g., two, three, four, five, six, seven, eight, nine, ten, or more) stabilizing modifications. Without limitations, the stabilizing modifications all can be present in one strand. In some embodiments, both the sense and the antisense strands comprise at least two stabilizing modifications. The stabilizing modification can occur on any nucleotide of the sense strand or antisense strand. For instance, the stabilizing modification can occur on every nucleotide on the sense strand or antisense strand; each stabilizing modification can occur in an alternating pattern on the sense strand or antisense strand; or the sense strand or antisense strand comprises both stabilizing modification in an alternating pattern. The alternating pattern of the stabilizing modifications on the sense strand may be the same or different from the antisense strand, and the alternating pattern of the stabilizing modifications on the sense strand can have a shift relative to the alternating pattern of the stabilizing modifications on the antisense strand.

In some embodiments, the antisense strand comprises at least two (e.g., two, three, four, five, six, seven, eight, nine, ten, or more) stabilizing modifications. Without limitations, a stabilizing modification in the antisense strand can be present at any positions.

In some embodiments, the antisense strand comprises stabilizing modifications at positions 2, 6, 8, 9, 14, and 16 from the 5'-end. In some other embodiments, the antisense strand comprises stabilizing modifications at positions 2, 6, 14, and 16 from the 5'-end. In still some other embodiments, the antisense strand comprises stabilizing modifications at positions 2, 14, and 16 from the 5'-end.

In some embodiments, the antisense strand comprises at least one stabilizing modification adjacent to the destabilizing modification. For example, the stabilizing modification can be the nucleotide at the 5'-end or the 3'-end of the destabilizing modification, i.e., at position −1 or +1 from the position of the destabilizing modification. In some embodiments, the antisense strand comprises a stabilizing modification at each of the 5'-end and the 3'-end of the destabilizing modification, i.e., positions −1 and +1 from the position of the destabilizing modification.

In some embodiments, the antisense strand comprises at least two stabilizing modifications at the 3'-end of the destabilizing modification, i.e., at positions +1 and +2 from the position of the destabilizing modification.

In some embodiments, the sense strand comprises at least two (e.g., two, three, four, five, six, seven, eight, nine, ten or more) stabilizing modifications. Without limitations, a stabilizing modification in the sense strand can be present at any positions. In some embodiments, the sense strand comprises stabilizing modifications at positions 7, 10, and 11 from the 5'-end. In some other embodiments, the sense strand comprises stabilizing modifications at positions 7, 9, 10, and 11 from the 5'-end. In some embodiments, the sense strand comprises stabilizing modifications at positions opposite or complimentary to positions 11, 12, and 15 of the antisense strand, counting from the 5'-end of the antisense strand. In some other embodiments, the sense strand comprises stabilizing modifications at positions opposite or complimentary to positions 11, 12, 13, and 15 of the antisense strand, counting from the 5'-end of the antisense strand. In some embodiments, the sense strand comprises a block of two, three, or four stabilizing modifications.

In some embodiments, the sense strand does not comprise a stabilizing modification in position opposite or complimentary to the thermally destabilizing modification of the duplex in the antisense strand.

Exemplary thermally stabilizing modifications include, but are not limited to, 2'-fluoro modifications. Other thermally stabilizing modifications include, but are not limited to, LNA.

In some embodiments, the dsRNA of the disclosure comprises at least four (e.g., four, five, six, seven, eight, nine, ten, or more) 2'-fluoro nucleotides. Without limitations, the 2'-fluoro nucleotides all can be present in one strand. In some embodiments, both the sense and the antisense strands comprise at least two 2'-fluoro nucleotides. The 2'-fluoro modification can occur on any nucleotide of the sense strand or antisense strand. For instance, the 2'-fluoro modification can occur on every nucleotide on the sense strand or antisense strand; each 2'-fluoro modification can occur in an alternating pattern on the sense strand or antisense strand; or the sense strand or antisense strand comprises both 2'-fluoro modifications in an alternating pattern. The alternating pattern of the 2'-fluoro modifications on the sense strand may be the same or different from the antisense strand, and the alternating pattern of the 2'-fluoro modifications on the sense strand can have a shift relative to the alternating pattern of the 2'-fluoro modifications on the antisense strand.

In some embodiments, the antisense strand comprises at least two (e.g., two, three, four, five, six, seven, eight, nine, ten, or more) 2'-fluoro nucleotides. Without limitations, a 2'-fluoro modification in the antisense strand can be present at any positions. In some embodiments, the antisense comprises 2'-fluoro nucleotides at positions 2, 6, 8, 9, 14, and 16 from the 5'-end. In some other embodiments, the antisense comprises 2'-fluoro nucleotides at positions 2, 6, 14, and 16 from the 5'-end. In still some other embodiments, the antisense comprises 2'-fluoro nucleotides at positions 2, 14, and 16 from the 5'-end.

In some embodiments, the antisense strand comprises at least one 2'-fluoro nucleotide adjacent to the destabilizing modification. For example, the 2'-fluoro nucleotide can be the nucleotide at the 5'-end or the 3'-end of the destabilizing modification, i.e., at position −1 or +1 from the position of the destabilizing modification. In some embodiments, the antisense strand comprises a 2'-fluoro nucleotide at each of the 5'-end and the 3'-end of the destabilizing modification, i.e., positions −1 and +1 from the position of the destabilizing modification.

In some embodiments, the antisense strand comprises at least two 2'-fluoro nucleotides at the 3'-end of the destabilizing modification, i.e., at positions +1 and +2 from the position of the destabilizing modification.

In some embodiments, the sense strand comprises at least two (e.g., two, three, four, five, six, seven, eight, nine, ten, or more) 2'-fluoro nucleotides. Without limitations, a 2'-fluoro modification in the sense strand can be present at any positions. In some embodiments, the antisense comprises 2'-fluoro nucleotides at positions 7, 10, and 11 from the 5'-end. In some other embodiments, the sense strand comprises 2'-fluoro nucleotides at positions 7, 9, 10, and 11 from the 5'-end. In some embodiments, the sense strand comprises 2'-fluoro nucleotides at positions opposite or complimentary to positions 11, 12, and 15 of the antisense strand, counting from the 5'-end of the antisense strand. In some other embodiments, the sense strand comprises 2'-fluoro nucleotides at positions opposite or complimentary to positions 11, 12, 13, and 15 of the antisense strand, counting from the 5'-end of the antisense strand. In some embodiments, the sense strand comprises a block of two, three, or four 2'-fluoro nucleotides.

In some embodiments, the sense strand does not comprise a 2'-fluoro nucleotide in position opposite or complimentary to the thermally destabilizing modification of the duplex in the antisense strand.

In some embodiments, the dsRNA molecule of the disclosure comprises a 21 nucleotides (nt) sense strand and a 23 nucleotides (nt) antisense, wherein the antisense strand contains at least one thermally destabilizing nucleotide, where the at least one thermally destabilizing nucleotide occurs in the seed region of the antisense strand (i.e., at position 2-9 of the 5'-end of the antisense strand), wherein one end of the dsRNA is blunt, while the other end is comprises a 2 nt overhang, and wherein the dsRNA optionally further has at least one (e.g., one, two, three, four, five, six, or all seven) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4, or 5 2'-fluoro modifications; (v) the sense strand comprises 1, 2, 3, 4, or 5 phosphorothioate internucleotide linkages; (vi) the dsRNA comprises at least four 2'-fluoro modifications; and (vii) the dsRNA comprises a blunt end at 5'-end of the antisense strand. Preferably, the 2 nt overhang is at the 3'-end of the antisense.

In some embodiments, every nucleotide in the sense strand and antisense strand of the dsRNA molecule may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2' hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases, the modification will occur at all of the subject positions in the nucleic acid but in many cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of an RNA or may only occur in a single strand region of an RNA. E.g., a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. E.g., it can be desirable to include purine nucleotides in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with LNA, HNA, CeNA, 2'-methoxyethyl, 2'-O-methyl, 2'-O-allyl, 2'-C-allyl, 2'-deoxy, or 2'-fluoro. The strands can contain more than one modification. In some embodiments, each residue of the sense strand and antisense strand is independently modified with 2'-O-methyl or 2'-fluoro. It is to be understood that these modifications are in addition to the at least one thermally destabilizing modification of the duplex present in the antisense strand.

At least two different modifications are typically present on the sense strand and antisense strand. Those two modifications may be the 2'-deoxy, 2'-O-methyl, or 2'-fluoro modifications, acyclic nucleotides or others. In some embodiments, the sense strand and antisense strand each comprises two differently modified nucleotides selected from 2'-O-methyl or 2'-deoxy. In some embodiments, each residue of the sense strand and antisense strand is independently modified with 2'-O-methyl nucleotide, 2'-deoxy nucleotide, 2'-deoxy-2'-fluoro nucleotide, 2'-O-N-methylacetamido (2'-O-NMA) nucleotide, a 2'-O-dimethylaminoethoxyethyl (2'-O-DMAEOE) nucleotide, 2'-O-aminopropyl (2'-O-AP) nucleotide, or 2'-ara-F nucleotide. Again, it is to be understood that these modifications are in addition to the at least one thermally destabilizing modification of the duplex present in the antisense strand.

In some embodiments, the dsRNA molecule of the disclosure comprises modifications of an alternating pattern, particular in the B1, B2, B3, B1', B2', B3', B4' regions. The term "alternating motif" or "alternative pattern" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AABBAABBAABB . . . ," "AABAABAABAAB . . . ," "AAABAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ", "ACACAC . . . " "BDBDBD . . . " or "CDCDCD . . . ," etc.

In some embodiments, the dsRNA molecule of the disclosure comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 3'-5' of the strand within the duplex region. As another example, the alternating motif in the sense strand may start with "AABBAABB" from 5'-3' of the strand and the alternating motif in the antisense strand may start with "BBAABBAA" from 3'-5' of the strand within the duplex region, so that there is a complete or partial shift of the modification patterns between the sense strand and the antisense strand.

The dsRNA molecule of the disclosure may further comprise at least one phosphorothioate or methylphosphonate internucleotide linkage. The phosphorothioate or methylphosphonate internucleotide linkage modification may occur on any nucleotide of the sense strand or antisense strand or both in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand comprises both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand.

In some embodiments, the dsRNA molecule comprises the phosphorothioate or methylphosphonate internucleotide linkage modification in the overhang region. For example, the overhang region comprises two nucleotides having a phosphorothioate or methylphosphonate internucleotide linkage between the two nucleotides. Internucleotide linkage modifications also may be made to link the overhang nucleotides with the terminal paired nucleotides within duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. Preferably, these terminal three nucleotides may be at the 3'-end of the antisense strand.

In some embodiments, the sense strand of the dsRNA molecule comprises 1-10 blocks of two to ten phosphorothioate or methylphosphonate internucleotide linkages separated by 1, 2, 3, 4, 5, 6, 7, 8, 9, 10, 11, 12, 13, 14, 15, or 16 phosphate internucleotide linkages, wherein one of the phosphorothioate or methylphosphonate internucleotide linkages is placed at any position in the oligonucleotide sequence and the said sense strand is paired with an antisense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of two phosphorothioate or methylphosphonate internucleotide linkages separated by 1, 2, 3, 4, 5, 6, 7, 8, 9, 10, 11, 12, 13, 14, 15, 16, 17, or 18 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of three phosphorothioate or methylphosphonate internucleotide linkages separated by 1, 2, 3, 4, 5, 6, 7, 8, 9, 10, 11, 12, 13, 14, 15, or 16 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of four phosphorothioate or methylphosphonate internucleotide linkages separated by 1, 2, 3, 4, 5, 6, 7, 8, 9, 10, 11, 12, 13, or 14 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of five phosphorothioate or methylphosphonate internucleotide linkages separated by 1, 2, 3, 4, 5, 6, 7, 8, 9, 10, 11, or 12 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of six phosphorothioate or methylphosphonate internucleotide linkages separated by 1, 2, 3, 4, 5, 6, 7, 8, 9, or 10 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of seven phosphorothioate or methylphosphonate internucleotide linkages separated by 1, 2, 3, 4, 5, 6, 7, or 8 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of eight phosphorothioate or methylphosphonate internucleotide linkages separated by 1, 2, 3, 4, 5, or 6 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of nine phosphorothioate or methylphosphonate internucleotide linkages separated by 1, 2, 3, or 4 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the dsRNA molecule of the disclosure further comprises one or more phosphorothioate or methylphosphonate internucleotide linkage modification within positions 1-10 of the termini position(s) of the sense or antisense strand. For example, at least 2, 3, 4, 5, 6, 7, 8, 9, or 10 nucleotides may be linked through phosphorothioate or methylphosphonate internucleotide linkage at one end or both ends of the sense or antisense strand.

In some embodiments, the dsRNA molecule of the disclosure further comprises one or more phosphorothioate or methylphosphonate internucleotide linkage modification within positions 1-10 of the internal region of the duplex of each of the sense or antisense strand. For example, at least 2, 3, 4, 5, 6, 7, 8, 9, or 10 nucleotides may be linked through phosphorothioate methylphosphonate internucleotide linkage at position 8-16 of the duplex region counting from the 5'-end of the sense strand; the dsRNA molecule can optionally further comprise one or more phosphorothioate or methylphosphonate internucleotide linkage modification within positions 1-10 of the termini position(s).

In some embodiments, the dsRNA molecule of the disclosure further comprises one to five phosphorothioate or methylphosphonate internucleotide linkage modification(s) within position 1-5 and one to five phosphorothioate or methylphosphonate internucleotide linkage modification(s) within position 18-23 of the sense strand (counting from the 5'-end), and one to five phosphorothioate or methylphosphonate internucleotide linkage modification at positions 1 and 2 and one to five within positions 18-23 of the antisense strand (counting from the 5'-end).

In some embodiments, the dsRNA molecule of the disclosure further comprises one phosphorothioate internucleotide linkage modification within position 1-5 and one phosphorothioate or methylphosphonate internucleotide linkage modification within position 18-23 of the sense strand (counting from the 5'-end), and one phosphorothioate internucleotide linkage modification at positions 1 and 2 and two phosphorothioate or methylphosphonate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and one phosphorothioate internucleotide linkage modification within positions 18-23 of the antisense strand (counting from the 5'-end).

In some embodiments, the dsRNA molecule of the disclosure further comprises one phosphorothioate internucleotide linkage modification within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA molecule of the disclosure further comprises one phosphorothioate internucleotide linkage modification within position 1-5 and one within position 18-23 of the sense strand (counting from the 5'-end), and two phosphorothioate internucleotide linkage modification at positions 1 and 2 and one phosphorothioate internucleotide linkage modification within positions 18-23 of the antisense strand (counting from the 5'-end).

In some embodiments, the dsRNA molecule of the disclosure further comprises one phosphorothioate internucleotide linkage modification within position 1-5 (counting from the 5'-end) of the sense strand, and two phosphorothioate internucleotide linkage modifications at positions 1 and 2 and one phosphorothioate internucleotide linkage modification within positions 18-23 of the antisense strand (counting from the 5'-end).

In some embodiments, the dsRNA molecule of the disclosure further comprises two phosphorothioate internucleotide linkage modifications within position 1-5 (counting from the 5'-end) of the sense strand, and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one within position 18-23 of the sense strand (counting from the 5'-end), and two phosphorothioate internucleotide linkage modifications at positions 1 and 2 and one phosphorothioate internucleotide linkage modification within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 20 and 21 of the sense strand (counting from the 5'-end), and one phosphorothioate internucleotide linkage modification at positions 1 and one at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 20 and 21 the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 21 and 22 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 21 and 22 the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 22 and 23 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 23 and 23 the antisense strand (counting from the 5'-end).

In some embodiments, compound of the disclosure comprises a pattern of backbone chiral centers. In some embodiments, a common pattern of backbone chiral centers comprises at least 5 internucleotidic linkages in the Sp configuration. In some embodiments, a common pattern of backbone chiral centers comprises at least 6 internucleotidic linkages in the Sp configuration. In some embodiments, a common pattern of backbone chiral centers comprises at least 7 internucleotidic linkages in the Sp configuration. In some embodiments, a common pattern of backbone chiral centers comprises at least 8 internucleotidic linkages in the Sp configuration. In some embodiments, a common pattern of backbone chiral centers comprises at least 9 internucleotidic linkages in the Sp configuration. In some embodiments, a common pattern of backbone chiral centers comprises at least 10 internucleotidic linkages in the Sp configuration. In some embodiments, a common pattern of backbone chiral centers comprises at least 11 internucleotidic linkages in the Sp configuration. In some embodiments, a common pattern of backbone chiral centers comprises at least 12 internucleotidic linkages in the Sp configuration. In some embodiments, a common pattern of backbone chiral centers comprises at least 13 internucleotidic linkages in the Sp configuration. In some embodiments, a common pattern of backbone chiral centers comprises at least 14 internucleotidic linkages in the Sp configuration. In some embodiments, a common pattern of backbone chiral centers comprises at least 15 internucleotidic linkages in the Sp configuration. In some embodiments, a common pattern of backbone chiral centers comprises at least 16 internucleotidic linkages in the Sp configuration. In some embodiments, a common pattern of backbone chiral centers comprises at least 17 internucleotidic linkages in the Sp configuration. In some embodiments, a common pattern of backbone chiral centers comprises at least 18 internucleotidic linkages in the Sp configuration. In some embodiments, a common pattern of backbone chiral centers comprises at least 19 internucleotidic linkages in the Sp configuration. In some embodiments, a common pattern of backbone chiral centers comprises no more than 8 internucleotidic linkages in the Rp configuration. In some embodiments, a common pattern of backbone chiral centers comprises no more than 7 internucleotidic linkages in the Rp configuration. In some embodiments, a common pattern of backbone chiral centers comprises no more than 6 internucleotidic linkages in the Rp configuration. In some embodiments, a common pattern of backbone chiral centers comprises no more than 5 internucleotidic linkages in the Rp configuration. In some embodiments, a common pattern of backbone chiral centers comprises no more than 4 internucleotidic linkages in the Rp configuration. In some embodiments, a common pattern of backbone chiral centers comprises no more than 3 internucleotidic linkages in the Rp configuration. In some embodiments, a common pattern of backbone chiral centers comprises no more than 2 internucleotidic linkages in the Rp configuration. In some embodiments, a common pattern of backbone chiral centers comprises no more than 1 internucleotidic linkages in the Rp configuration. In some embodiments, a common pattern of backbone chiral centers comprises no more than 8 internucleotidic linkages which are not chiral (as a non-limiting example, a phosphodiester). In some embodiments, a common pattern of backbone chiral centers comprises no more than 7 internucleotidic linkages which are not chiral. In some embodiments, a common pattern of backbone chiral centers comprises no more than 6 internucleotidic linkages which are not chiral. In some embodiments, a common pattern of backbone chiral centers comprises no more than 5 internucleotidic linkages which are not chiral. In some embodiments, a common pattern of backbone chiral centers comprises no more than 4 internucleotidic linkages which are not chiral. In some embodiments, a common pattern of backbone chiral centers comprises no more than 3 internucleotidic linkages which are not chiral. In some embodiments, a common pattern of backbone chiral centers comprises no more than 2 internucleotidic linkages which are not chiral. In some embodiments, a common pattern of backbone chiral centers comprises no more than 1 internucleotidic linkages which are not chiral. In some embodiments, a common pattern of backbone chiral centers comprises at least 10 internucleotidic linkages in the Sp configuration, and no more than 8 internucleotidic linkages which are not chiral. In some embodiments, a common pattern of backbone chiral centers comprises at least 11 internucleotidic linkages in the Sp configuration, and no more than 7 internucleotidic linkages which are not chiral. In some embodiments, a common pattern of backbone chiral centers comprises at least 12 internucleotidic linkages in the Sp configuration, and no more than 6 internucleotidic linkages which are not chiral. In some embodiments, a common pattern of backbone chiral centers comprises at least 13 internucleotidic linkages in the Sp configuration, and no more than 6 internucleotidic linkages which are not chiral. In some embodiments, a common pattern of backbone chiral centers comprises at least 14 internucleotidic linkages in the Sp configuration, and no more than 5 internucleotidic linkages which are not chiral. In some embodiments, a common pattern of backbone chiral centers comprises at least 15 internucleotidic linkages in the Sp configuration, and no more than 4 internucleotidic linkages which are not chiral. In some embodiments, the internucleotidic linkages in the Sp configuration are optionally contiguous or not contiguous. In some embodiments, the internucleotidic linkages in the Rp configuration are optionally contiguous or not contiguous. In some embodiments, the internucleotidic linkages which are not chiral are optionally contiguous or not contiguous.

In some embodiments, compound of the disclosure comprises a block is a stereochemistry block. In some embodiments, a block is an Rp block in that each internucleotidic linkage of the block is Rp. In some embodiments, a 5'-block is an Rp block. In some embodiments, a 3'-block is an Rp block. In some embodiments, a block is an Sp block in that each internucleotidic linkage of the block is Sp. In some embodiments, a 5'-block is an Sp block. In some embodiments, a 3'-block is an Sp block. In some embodiments, provided oligonucleotides comprise both Rp and Sp blocks. In some embodiments, provided oligonucleotides comprise one or more Rp but no Sp blocks. In some embodiments, provided oligonucleotides comprise one or more Sp but no Rp blocks. In some embodiments, provided oligonucleotides comprise one or more PO blocks wherein each internucleotidic linkage in a natural phosphate linkage.

In some embodiments, compound of the disclosure comprises a 5'-block is an Sp block wherein each sugar moiety comprises a 2'-F modification. In some embodiments, a 5'-block is an Sp block wherein each of internucleotidic linkage is a modified internucleotidic linkage and each sugar moiety comprises a 2'-F modification. In some embodiments, a 5'-block is an Sp block wherein each of internucleotidic linkage is a phosphorothioate linkage and each sugar moiety comprises a 2'-F modification. In some embodiments, a 5'-block comprises 4 or more nucleoside units. In some embodiments, a 5'-block comprises 5 or more nucleoside units. In some embodiments, a 5'-block comprises 6 or more nucleoside units. In some embodiments, a 5'-block comprises 7 or more nucleoside units. In some embodiments, a 3'-block is an Sp block wherein each sugar moiety comprises a 2'-F modification. In some embodiments, a 3'-block is an Sp block wherein each of internucleotidic linkage is a modified internucleotidic linkage and each sugar moiety comprises a 2'-F modification. In some embodiments, a 3'-block is an Sp block wherein each of internucleotidic linkage is a phosphorothioate linkage and each sugar moiety comprises a 2'-F modification. In some embodiments, a 3'-block comprises 4 or more nucleoside units. In some embodiments, a 3'-block comprises 5 or more nucleoside units. In some embodiments, a 3'-block comprises 6 or more nucleoside units. In some embodiments, a 3'-block comprises 7 or more nucleoside units.

In some embodiments, compound of the disclosure comprises a type of nucleoside in a region or an oligonucleotide is followed by a specific type of internucleotidic linkage, e.g., natural phosphate linkage, modified internucleotidic linkage, Rp chiral internucleotidic linkage, Sp chiral internucleotidic linkage, etc. In some embodiments, A is followed by Sp. In some embodiments, A is followed by Rp. In some embodiments, A is followed by natural phosphate linkage (PO). In some embodiments, U is followed by Sp. In some embodiments, U is followed by Rp. In some embodiments, U is followed by natural phosphate linkage (PO). In some embodiments, C is followed by Sp. In some embodiments, C is followed by Rp. In some embodiments, C is followed by natural phosphate linkage (PO). In some embodiments, G is followed by Sp. In some embodiments, G is followed by Rp. In some embodiments, G is followed by natural phosphate linkage (PO). In some embodiments, C and U are followed by Sp. In some embodiments, C and U are followed by Rp. In some embodiments, C and U are followed by natural phosphate linkage (PO). In some embodiments, A and G are followed by Sp. In some embodiments, A and G are followed by Rp.

In some embodiments, the dsRNA molecule of the disclosure comprises mismatch(es) with the target, within the duplex, or combinations thereof. The mismatch can occur in the overhang region or the duplex region. The base pair can be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In some embodiments, the dsRNA molecule of the disclosure comprises at least one of the first 1, 2, 3, 4, or 5 base pairs within the duplex regions from the 5'-end of the antisense strand can be chosen independently from the group of: A:U, G:U, I:C, and mismatched pairs, e.g., non-canonical or other than canonical pairings or pairings which include a universal base, to promote the dissociation of the antisense strand at the 5'-end of the duplex.

In some embodiments, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

It was found that introducing 4'-modified or 5'-modified nucleotide to the 3'-end of a phosphodiester (PO), phosphorothioate (PS), or phosphorodithioate (PS2) linkage of a dinucleotide at any position of single stranded or double stranded oligonucleotide can exert steric effect to the internucleotide linkage and, hence, protecting or stabilizing it against nucleases.

In some embodiments, 5'-modified nucleoside is introduced at the 3'-end of a dinucleotide at any position of single stranded or double stranded siRNA. For instance, a 5'-alkylated nucleoside may be introduced at the 3'-end of a dinucleotide at any position of single stranded or double stranded siRNA. The alkyl group at the 5' position of the ribose sugar can be racemic or chirally pure R or S isomer. An exemplary 5'-alkylated nucleoside is 5'-methyl nucleoside. The 5'-methyl can be either racemic or chirally pure R or S isomer.

In some embodiments, 4'-modified nucleoside is introduced at the 3'-end of a dinucleotide at any position of single stranded or double stranded siRNA. For instance, a 4'-alkylated nucleoside may be introduced at the 3'-end of a dinucleotide at any position of single stranded or double stranded siRNA. The alkyl group at the 4' position of the ribose sugar can be racemic or chirally pure R or S isomer. An exemplary 4'-alkylated nucleoside is 4'-methyl nucleoside. The 4'-methyl can be either racemic or chirally pure R or S isomer. Alternatively, a 4'-O-alkylated nucleoside may be introduced at the 3'-end of a dinucleotide at any position of single stranded or double stranded siRNA. The 4'-O-alkyl of the ribose sugar can be racemic or chirally pure R or S isomer. An exemplary 4'-O-alkylated nucleoside is 4'-O-methyl nucleoside. The 4'-O-methyl can be either racemic or chirally pure R or S isomer.

In some embodiments, 5'-alkylated nucleoside is introduced at any position on the sense strand or antisense strand of a dsRNA, and such modification maintains or improves potency of the dsRNA. The 5'-alkyl can be either racemic or chirally pure R or S isomer. An exemplary 5'-alkylated nucleoside is 5'-methyl nucleoside. The 5'-methyl can be either racemic or chirally pure R or S isomer.

In some embodiments, 4'-alkylated nucleoside is introduced at any position on the sense strand or antisense strand of a dsRNA, and such modification maintains or improves potency of the dsRNA. The 4'-alkyl can be either racemic or chirally pure R or S isomer. An exemplary 4'-alkylated nucleoside is 4'-methyl nucleoside. The 4'-methyl can be either racemic or chirally pure R or S isomer.

In some embodiments, 4'-O-alkylated nucleoside is introduced at any position on the sense strand or antisense strand of a dsRNA, and such modification maintains or improves potency of the dsRNA. The 5'-alkyl can be either racemic or chirally pure R or S isomer. An exemplary 4'-O-alkylated nucleoside is 4'-O-methyl nucleoside. The 4'-O-methyl can be either racemic or chirally pure R or S isomer.

In some embodiments, the dsRNA molecule of the disclosure can comprise 2'-5' linkages (with 2'-H, 2'-OH, and 2'-OMe and with P═O or P═S). For example, the 2'-5' linkages modifications can be used to promote nuclease resistance or to inhibit binding of the sense to the antisense strand, or can be used at the 5' end of the sense strand to avoid sense strand activation by RISC.

In another embodiment, the dsRNA molecule of the disclosure can comprise L sugars (e.g., L ribose, L-arabinose with 2'-H, 2'-OH and 2'-OMe). For example, these L sugars modifications can be used to promote nuclease resistance or to inhibit binding of the sense to the antisense strand, or can be used at the 5' end of the sense strand to avoid sense strand activation by RISC.

Various publications describe multimeric siRNA which can all be used with the dsRNA of the disclosure. Such publications include WO2007/091269, U.S. Pat. No. 7,858,769, WO2010/141511, WO2007/117686, WO2009/014887, and WO2011/031520 which are hereby incorporated by their entirely.

In some embodiments dsRNA molecules of the disclosure are 5' phosphorylated or include a phosphoryl analog at the 5' prime terminus. 5'-phosphate modifications include those which are compatible with RISC mediated gene silencing. Suitable modifications include: 5'-monophosphate ($(HO)_2(O)P—O-5'$); 5'-diphosphate ($(HO)_2(O)P—O—P(HO)(O)—O-5'$); 5'-triphosphate ($(HO)_2(O)P—O—(HO)(O)P—O—P(HO)(O)—O-5'$); 5'-guanosine cap (7-methylated or non-methylated) (7m-G-O-5'-(HO)(O)P—O—(HO)(O)P—O—P(HO)(O)—O-5'); 5'-adenosine cap (Appp), and any modified or unmodified nucleotide cap structure (N—O-5'-(HO)(O)P—O—(HO)(O)P—O—P(HO)(O)—O-5'); 5'-monothiophosphate (phosphorothioate; $(HO)_2(S)P—O-5'$); 5'-monodithiophosphate (phosphorodithioate; (HO)(HS)(S)P—O-5'), 5'-phosphorothiolate ($(HO)_2(O)P—S-5'$); any additional combination of oxygen/sulfur replaced monophosphate, diphosphate and triphosphates (e.g. 5'-alpha-thiotriphosphate, 5'-gamma-thiotriphosphate, etc.), 5'-phosphoramidates ($(HO)_2(O)P—NH-5'$, $(HO)(NH_2)(O)P—O-5'$), 5'-alkylphosphonates (R=alkyl=methyl, ethyl, isopropyl, propyl, etc., e.g. RP(OH)(O)—O-5'-, 5'-alkenylphosphonates (i.e. vinyl, substituted vinyl), $(OH)_2(O)P-5'-CH_2-$), 5'-alkyletherphosphonates (R=alkylether=methoxymethyl (MeOCH2-), ethoxymethyl, etc., e.g. RP(OH)(O)—O-5'-). In one example, the modification can in placed in the antisense strand of a dsRNA molecule.

Linkers

In some embodiments, the conjugate or ligand described herein can be attached to an iRNA oligonucleotide with various linkers that can be cleavable or non-cleavable.

Linkers typically comprise a direct bond or an atom such as oxygen or sulfur, a unit such as NR8, C(O), C(O)NH, SO, $SO_2$, $SO_2NH$ or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In some embodiments, the linker is between about 1-24 atoms, 2-24, 3-24, 4-24, 5-24, 6-24, 6-18, 7-18, 8-18 atoms, 7-17, 8-17, 6-16, 7-16, or 8-16 atoms.

In some embodiments, a dsRNA of the disclosure is conjugated to a bivalent or trivalent branched linker selected from the group of structures shown in any of formula (XXXI)-(XXXIV):

Formula XXXI (IV)

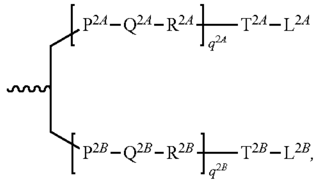

Formula XXXII (V)

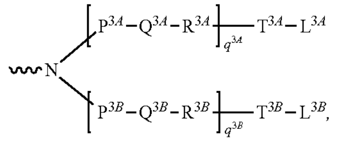

-continued

Formula XXXIII

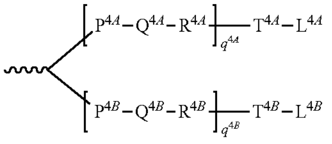

Formula XXXIV

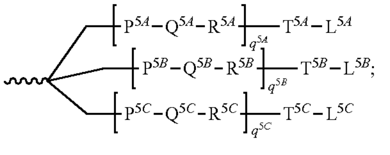

wherein:

q2A, q2B, q3A, q3B, q4A, q4B, q5A, q5B and q5C represent independently for each occurrence 0-20 and wherein the repeating unit can be the same or different;

$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), $CH_2$, $CH_2NH$ or $CH_2O$;

$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, $N(R^N)$, C(R')=C(R"), C≡C or C(O);

$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, $CH_2$, C(O)O, C(O)NH, $NHCH(R^a)C(O)$, $-C(O)-CH(R^a)-NH-$, CO, CH=N—O,

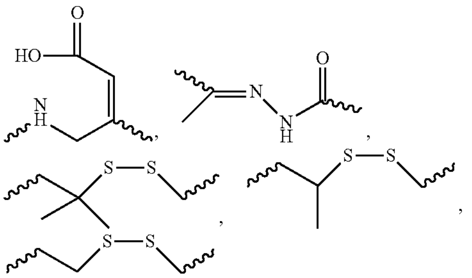

or heterocyclyl;

$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XXXV):

Formula XXXV (VII)

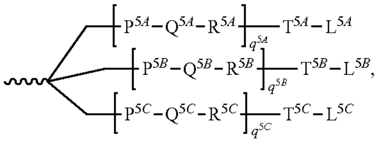

wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

A cleavable linking group is one which is sufficiently stable outside the cell, but which upon entry into a target cell is cleaved to release the two parts the linker is holding together. In a some embodiments, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a suitable pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In some embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

Redox Cleavable Linking Groups

In some embodiments, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

Phosphate-Based Cleavable Linking Groups

In some embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. In some embodiments, phosphate-based linking groups are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, —O—P(S)(H)—S—. In some embodiments, a phosphate-based linking group is —O—P(O)(OH)—O—. These candidates can be evaluated using methods analogous to those described above.

Acid Cleavable Linking Groups

In some embodiments, a cleavable linker comprises an acid cleavable linking group. An acid cleavable linking group is a linking group that is cleaved under acidic conditions. In some embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). In some embodiments, the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

Ester-Based Cleavable Linking Groups

In some embodiments, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

Peptide-Based Cleavable Linking Groups

In some embodiments, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynylene. A peptide bond is a special type of amide bond formed between amino acids to yield peptides and proteins. The peptide-based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above. Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717, 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; 8,106,022, the entire contents of each of which is herein incorporated by reference.

It is not necessary for all positions in a given compound to be uniformly modified, and in fact more than one of the aforementioned modifications may be incorporated in a single compound or even at a single nucleoside within an iRNA. The present disclosure also includes iRNA compounds that are chimeric compounds.

"Chimeric" iRNA compounds, or "chimeras," in the context of the present disclosure, are iRNA compounds, e.g., dsRNAs, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, and/or increased binding affinity for the target nucleic acid. An additional region of the iRNA may serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.,* 2007, 365(1):54-61; Letsinger et al., *Proc. Natl. Acad. Sci. USA,* 1989, 86:6553), cholic acid (Manoharan et al., *Bioorg. Med. Chem. Lett.,* 1994, 4:1053), a thioether, e.g., hexyl-S-tritylthiol (Manoharan et al., *Ann. N.Y. Acad. Sci.,* 1992, 660:306; Manoharan et al., *Bioorg. Med. Chem. Let.,* 1993, 3:2765), a thiocholesterol (Oberhauser et al., *Nucl. Acids Res.,* 1992, 20:533), an aliphatic chain, e.g., dodecandiol or undecyl residues (Saison-Behmoaras et al., *EMBO J.,* 1991, 10:111; Kabanov et al., *FEBS Lett.,* 1990, 259:327; Svinarchuk et al., *Biochimie,* 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.,* 1995, 36:3651; Shea et al., *Nucl. Acids Res.,* 1990, 18:3777), a polyamine or a polyethylene glycol chain (Manoharan et al., *Nucleosides & Nucleotides,* 1995, 14:969), or adamantane acetic acid (Manoharan et al., *Tetrahedron Lett.,* 1995, 36:3651), a palmityl moiety (Mishra et al., *Biochim. Biophys. Acta,* 1995, 1264:229), or an octadecylamine or hexylamino-carbonyl-oxycholesterol moiety (Crooke et al., *J. Pharmacol. Exp. Ther.,* 1996, 277:923). Representative United States patents that teach the preparation of such RNA conjugates have been listed above. Typical conjugation protocols involve the synthesis of an RNAs bearing an aminolinker at one or more positions of the sequence. The amino group is then reacted with the molecule being conjugated using appropriate coupling or activating reagents. The conjugation reaction may be performed either with the RNA still bound to the solid support or following cleavage of the RNA, in solution phase. Purification of the RNA conjugate by HPLC typically affords the pure conjugate.

Delivery of iRNA

The delivery of an iRNA to a subject in need thereof can be achieved in a number of different ways. In vivo delivery can be performed directly by administering a composition comprising an iRNA, e.g. a dsRNA, to a subject. Alternatively, delivery can be performed indirectly by administering one or more vectors that encode and direct the expression of the iRNA. These alternatives are discussed further below.

Direct Delivery

In general, any method of delivering a nucleic acid molecule can be adapted for use with an iRNA (see e.g., Akhtar S. and Julian R L. (1992) *Trends Cell. Biol.* 2(5): 139-144 and WO94/02595, which are incorporated herein by reference in their entireties). However, there are three factors that are important to consider in order to successfully deliver an iRNA molecule in vivo: (a) biological stability of the delivered molecule, (2) preventing non-specific effects, and (3) accumulation of the delivered molecule in the target tissue. The non-specific effects of an iRNA can be minimized by local administration, for example by direct injection or implantation into a tissue (as a non-limiting example, the eye) or topically administering the preparation. Local administration to a treatment site maximizes local concentration of the agent, limits the exposure of the agent to systemic tissues that may otherwise be harmed by the agent or that may degrade the agent, and permits a lower total dose of the iRNA molecule to be administered. Several studies have shown successful knockdown of gene products when an iRNA is administered locally. For example, intraocular delivery of a VEGF dsRNA by intravitreal injection in cynomolgus monkeys (Tolentino, M J., et al (2004) *Retina* 24:132-138) and subretinal injections in mice (Reich, S J., et al (2003) *Mol. Vis.* 9:210-216) were both shown to prevent neovascularization in an experimental model of age-related macular degeneration. In addition, direct intratumoral injection of a dsRNA in mice reduces tumor volume (Pille, J., et al (2005) *Mol. Ther.* 11:267-274) and can prolong survival of tumor-bearing mice (Kim, W J., et al (2006) *Mol. Ther.* 14:343-350; Li, S., et al (2007) *Mol. Ther.* 15:515-523). RNA interference has also shown success with local delivery to the CNS by direct injection (Dorn, G., et al. (2004) *Nucleic Acids* 32:e49; Tan, P H., et al (2005) *Gene Ther.* 12:59-66; Makimura, H., et al (2002) *BMC Neurosci.* 3:18; Shishkina, G T., et al (2004) *Neuroscience* 129:521-528; Thakker, E R., et al (2004) *Proc. Natl. Acad. Sci. U.S.A.* 101:17270-17275; Akaneya, Y., et al (2005) *J. Neurophysiol.* 93:594-602) and to the lungs by intranasal administration (Howard, K A., et al (2006) *Mol. Ther.* 14:476-484; Zhang, X., et al (2004) *J. Biol. Chem.* 279:10677-10684; Bitko, V., et al (2005) *Nat. Med.* 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo.

Modification of the RNA or the pharmaceutical carrier can also permit targeting of the iRNA composition to the target tissue and avoid undesirable off-target effects. iRNA molecules can be modified by chemical conjugation to other groups, e.g., a lipid or carbohydrate group as described herein. Such conjugates can be used to target iRNA to particular cells, e.g., liver cells, e.g., hepatocytes. For example, GalNAc conjugates or lipid (e.g., LNP) formulations can be used to target iRNA to particular cells, e.g., liver cells, e.g., hepatocytes.

iRNA molecules can also be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) *Nature* 432:173-178). Conjugation of an iRNA to an aptamer has been shown to inhibit tumor growth and mediate tumor regression in a mouse model of prostate cancer (McNamara, J O., et al (2006) *Nat. Biotechnol.* 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H., et al (2008)

*Journal of Controlled Release* 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R., et al (2003) *J. Mol. Biol* 327:761-766; Verma, U N., et al (2003) *Clin. Cancer Res.* 9:1291-1300; Arnold, A S et al (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N., et al (2003), supra), Oligofectamine, "solid nucleic acid lipid particles" (Zimmermann, T S., et al (2006) *Nature* 441:111-114), cardiolipin (Chien, P Y., et al (2005) *Cancer Gene Ther.* 12:321-328; Pal, A., et al (2005) *Int J. Oncol.* 26:1087-1091), polyethyleneimine (Bonnet M E., et al (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A., et al (2007) *Biochem. Soc. Trans.* 35:61-67; Yoo, H., et al (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

Vector Encoded iRNAs

In another aspect, iRNA targeting VEGF-A can be expressed from transcription units inserted into DNA or RNA vectors (see, e.g., Couture, A, et al., *TIG.* (1996), 12:5-10; Skillern, A., et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively, each individual strand of a dsRNA can be transcribed by promoters both of which are located on the same expression plasmid. In some embodiments, a dsRNA is expressed as an inverted repeat joined by a linker polynucleotide sequence such that the dsRNA has a stem and loop structure.

An iRNA expression vector is typically a DNA plasmid or viral vector. An expression vector compatible with eukaryotic cells, e.g., with vertebrate cells, can be used to produce recombinant constructs for the expression of an iRNA as described herein. Eukaryotic cell expression vectors are well known in the art and are available from a number of commercial sources. Typically, such vectors contain convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

An iRNA expression plasmid can be transfected into a target cell as a complex with a cationic lipid carrier (e.g., Oligofectamine) or a non-cationic lipid-based carrier (e.g., Transit-TKO™). Multiple lipid transfections for iRNA-mediated knockdowns targeting different regions of a target RNA over a period of a week or more are also contemplated by the disclosure. Successful introduction of vectors into host cells can be monitored using various known methods. For example, transient transfection can be signaled with a reporter, such as a fluorescent marker, such as Green Fluorescent Protein (GFP). Stable transfection of cells ex vivo can be ensured using markers that provide the transfected cell with resistance to specific environmental factors (e.g., antibiotics and drugs), such as hygromycin B resistance.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct may be incorporated into vectors capable of episomal replication, e.g EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are further described below.

Vectors useful for the delivery of an iRNA will include regulatory elements (promoter, enhancer, etc.) sufficient for expression of the iRNA in the desired target cell or tissue. The regulatory elements can be chosen to provide either constitutive or regulated/inducible expression.

Expression of the iRNA can be precisely regulated, for example, by using an inducible regulatory sequence that is sensitive to certain physiological regulators, e.g., circulating glucose levels, or hormones (Docherty et al., 1994, *FASEB J.* 8:20-24). Such inducible expression systems, suitable for the control of dsRNA expression in cells or in mammals include, for example, regulation by ecdysone, by estrogen, progesterone, tetracycline, chemical inducers of dimerization, and isopropyl-β-D1-thiogalactopyranoside (IPTG). A person skilled in the art would be able to choose the appropriate regulatory/promoter sequence based on the intended use of the iRNA transgene.

In a specific embodiment, viral vectors that contain nucleic acid sequences encoding an iRNA can be used. For example, a retroviral vector can be used (see Miller et al., *Meth. Enzymol.* 217:581-599 (1993)). These retroviral vectors contain the components necessary for the correct packaging of the viral genome and integration into the host cell DNA. The nucleic acid sequences encoding an iRNA are cloned into one or more vectors, which facilitates delivery of the nucleic acid into a patient. More detail about retroviral vectors can be found, for example, in Boesen et al., *Biotherapy* 6:291-302 (1994), which describes the use of a retroviral vector to deliver the mdr1 gene to hematopoietic stem cells in order to make the stem cells more resistant to chemotherapy. Other references illustrating the use of retroviral vectors in gene therapy are: Clowes et al., *J. Clin. Invest.* 93:644-651 (1994); Kiem et al., *Blood* 83:1467-1473 (1994); Salmons and Gunzberg, *Human Gene Therapy* 4:129-141 (1993); and Grossman and Wilson, *Curr. Opin. in Genetics and Devel.* 3:110-114 (1993). Lentiviral vectors contemplated for use include, for example, the HIV based vectors described in U.S. Pat. Nos. 6,143,520; 5,665,557; and 5,981,276, which are herein incorporated by reference.

Adenoviruses are also contemplated for use in delivery of iRNAs. Adenoviruses are especially attractive vehicles, e.g., for delivering genes to respiratory epithelia. Adenoviruses naturally infect respiratory epithelia where they cause a mild disease. Other targets for adenovirus-based delivery systems are liver, the central nervous system, endothelial cells, and muscle. Adenoviruses have the advantage of being capable of infecting non-dividing cells. Kozarsky and Wilson, *Current Opinion in Genetics and Development* 3:499-503 (1993) present a review of adenovirus-based gene therapy. Bout et al., *Human Gene Therapy* 5:3-10 (1994) demonstrated the use of adenovirus vectors to transfer genes to the respiratory epithelia of rhesus monkeys. Other instances of the use of adenoviruses in gene therapy can be found in Rosenfeld et al., *Science* 252:431-434 (1991); Rosenfeld et al., *Cell* 68:143-155 (1992); Mastrangeli et al., *J. Clin. Invest.* 91:225-234 (1993); PCT Publication WO94/12649; and Wang, et al., *Gene Therapy* 2:775-783 (1995). A suitable AV vector for expressing an iRNA featured in the disclosure, a method for constructing the recombinant AV vector, and a method for delivering the vector into target cells, are described in Xia H et al. (2002), *Nat. Biotech.* 20: 1006-1010.

Use of Adeno-associated virus (AAV) vectors is also contemplated (Walsh et al., *Proc. Soc. Exp. Biol. Med.* 204:289-300 (1993); U.S. Pat. No. 5,436,146). In some embodiments, the iRNA can be expressed as two separate, complementary single-stranded RNA molecules from a recombinant AAV vector having, for example, either the U6 or H1 RNA promoters, or the cytomegalovirus (CMV) promoter. Suitable AAV vectors for expressing the dsRNA featured in the disclosure, methods for constructing the recombinant AV vector, and methods for delivering the vectors into target cells are described in Samulski R et al. (1987), *J. Virol.* 61: 3096-3101; Fisher K J et al. (1996), *J. Virol.,* 70: 520-532; Samulski R et al. (1989), *J. Virol.* 63: 3822-3826; U.S. Pat. Nos. 5,252,479; 5,139,941; International Patent Application No. WO 94/13788; and International Patent Application No. WO 93/24641, the entire disclosures of which are herein incorporated by reference.

Another typical viral vector is a pox virus such as a vaccinia virus, for example an attenuated vaccinia such as Modified Virus Ankara (MVA) or NYVAC, an avipox such as fowl pox or canary pox.

The tropism of viral vectors can be modified by pseudotyping the vectors with envelope proteins or other surface antigens from other viruses, or by substituting different viral capsid proteins, as appropriate. For example, lentiviral vectors can be pseudotyped with surface proteins from vesicular stomatitis virus (VSV), rabies, Ebola, Mokola, and the like. AAV vectors can be made to target different cells by engineering the vectors to express different capsid protein serotypes; see, e.g., Rabinowitz J E et al. (2002), *J Virol* 76:791-801, the entire disclosure of which is herein incorporated by reference.

The pharmaceutical preparation of a vector can include the vector in an acceptable diluent, or can include a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

III. Pharmaceutical Compositions Containing iRNA

In some embodiments, the disclosure provides pharmaceutical compositions containing an iRNA, as described herein, and a pharmaceutically acceptable carrier. The pharmaceutical composition containing the iRNA is useful for treating a disease or disorder related to the expression or activity of VEGF-A (e.g., an angiogenic ocular disorder). Such pharmaceutical compositions are formulated based on the mode of delivery. In some embodiments, compositions can be formulated for localized delivery, e.g., by intraocular delivery (e.g., intravitreal administration, e.g., intravitreal injection; transscleral administration, e.g., transscleral injection; subconjunctival administration, e.g., subconjunctival injection; retrobulbar administration, e.g., retrobulbar injection; intracameral administration, e.g., intracameral injection; or subretinal administration, e.g., subretinal injection). In other embodiments, compositions can be formulated for topical delivery. In another example, compositions can be formulated for systemic administration via parenteral delivery, e.g., by intravenous (IV) delivery. In some embodiments, a composition provided herein (e.g., a composition comprising a GalNAc conjugate or an LNP formulation) is formulated for intravenous delivery.

The pharmaceutical compositions featured herein are administered in a dosage sufficient to inhibit expression of VEGF-A. In general, a suitable dose of iRNA will be in the range of 0.01 to 200.0 milligrams per kilogram body weight of the recipient per day. The pharmaceutical composition may be administered once daily, or the iRNA may be administered as two, three, or more sub-doses at appropriate intervals throughout the day or even using continuous infusion or delivery through a controlled release formulation. In that case, the iRNA contained in each sub-dose must be correspondingly smaller in order to achieve the total daily dosage. The dosage unit can also be compounded for delivery over several days, e.g., using a conventional sustained release formulation which provides sustained release of the iRNA over a several day period. Sustained release formulations are well known in the art and are particularly useful for delivery of agents at a particular site, such as can be used with the agents of the present disclosure. In this embodiment, the dosage unit contains a corresponding multiple of the daily dose.

The effect of a single dose on VEGF-A levels can be long lasting, such that subsequent doses are administered at not more than 3, 4, or 5-day intervals, or at not more than 1, 2, 3, 4, 12, 24, or 36-week intervals.

The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual iRNAs encompassed by the disclosure can be made using conventional methodologies or on the basis of in vivo testing using a suitable animal model.

A suitable animal model, e.g., a mouse or a cynomolgus monkey, e.g., an animal containing a transgene expressing human VEGF-A, can be used to determine the therapeutically effective dose and/or an effective dosage regimen administration of VEGF-A siRNA.

The present disclosure also includes pharmaceutical compositions and formulations that include the iRNA compounds featured herein. The pharmaceutical compositions of the present disclosure may be administered in a number of ways depending upon whether local or systemic treatment is desired and upon the area to be treated. Administration may be local (e.g., by intraocular injection), topical (e.g., by an eye drop solution), or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal, or intraventricular administration.

Pharmaceutical compositions and formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful. Suitable topical formulations include those in which the iRNAs featured in the disclosure are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). iRNAs featured in the disclosure may be encapsulated within liposomes or may form complexes thereto, in particular to cationic liposomes. Alternatively, iRNAs may be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a C120 alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

Liposomal Formulations

There are many organized surfactant structures besides microemulsions that have been studied and used for the formulation of drugs. These include monolayers, micelles, bilayers and vesicles. Vesicles, such as liposomes, have attracted great interest because of their specificity and the duration of action they offer from the standpoint of drug delivery. As used in the present disclosure, the term "liposome" means a vesicle composed of amphiphilic lipids arranged in a spherical bilayer or bilayers.

Liposomes are unilamellar or multilamellar vesicles which have a membrane formed from a lipophilic material and an aqueous interior. The aqueous portion contains the composition to be delivered. Cationic liposomes possess the advantage of being able to fuse to the cell wall. Non-cationic liposomes, although not able to fuse as efficiently with the cell wall, are taken up by macrophages in vivo.

In order to traverse intact mammalian skin, lipid vesicles must pass through a series of fine pores, each with a diameter less than 50 nm, under the influence of a suitable transdermal gradient. Therefore, it is desirable to use a liposome which is highly deformable and able to pass through such fine pores.

Further advantages of liposomes include; liposomes obtained from natural phospholipids are biocompatible and biodegradable; liposomes can incorporate a wide range of water and lipid soluble drugs; liposomes can protect encapsulated drugs in their internal compartments from metabolism and degradation (Rosoff, in *Pharmaceutical Dosage Forms*, Lieberman, Rieger and Banker (Eds.), 1988, Marcel Dekker, Inc., New York, N.Y., volume 1, p. 245). Important considerations in the preparation of liposome formulations are the lipid surface charge, vesicle size and the aqueous volume of the liposomes.

Liposomes are useful for the transfer and delivery of active ingredients to the site of action. Because the liposomal membrane is structurally similar to biological membranes, when liposomes are applied to a tissue, the liposomes start to merge with the cellular membranes and as the merging of the liposome and cell progresses, the liposomal contents are emptied into the cell where the active agent may act.

Liposomal formulations have been the focus of extensive investigation as the mode of delivery for many drugs. There is growing evidence that for topical administration, liposomes present several advantages over other formulations. Such advantages include reduced side-effects related to high systemic absorption of the administered drug, increased accumulation of the administered drug at the desired target, and the ability to administer a wide variety of drugs, both hydrophilic and hydrophobic, into the skin.

Several reports have detailed the ability of liposomes to deliver agents including high-molecular weight DNA into the skin. Compounds including analgesics, antibodies, hormones and high-molecular weight DNAs have been administered to the skin. The majority of applications resulted in the targeting of the upper epidermis Liposomes fall into two broad classes. Cationic liposomes are positively charged liposomes which interact with the negatively charged DNA molecules to form a stable complex. The positively charged DNA/liposome complex binds to the negatively charged cell surface and is internalized in an endosome. Due to the acidic pH within the endosome, the liposomes are ruptured, releasing their contents into the cell cytoplasm (Wang et al., *Biochem. Biophys. Res. Commun.,* 1987, 147, 980-985).

Liposomes which are pH-sensitive or negatively charged, entrap DNA rather than complex with it. Since both the DNA and the lipid are similarly charged, repulsion rather than complex formation occurs. Nevertheless, some DNA is entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., *Journal of Controlled Release,* 1992, 19, 269-274).

One major type of liposomal composition includes phospholipids other than naturally derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Several studies have assessed the topical delivery of liposomal drug formulations to the skin. Application of liposomes containing interferon to guinea pig skin resulted in a reduction of skin herpes sores while delivery of interferon via other means (e.g., as a solution or as an emulsion) were ineffective (Weiner et al., *Journal of Drug Targeting,* 1992, 2, 405-410). Further, an additional study tested the efficacy of interferon administered as part of a liposomal formulation to the administration of interferon using an aqueous system, and concluded that the liposomal formulation was superior to aqueous administration (du Plessis et al., *Antiviral Research,* 1992, 18, 259-265).

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporin-A into different layers of the skin (Hu et al. S.T.P. *Pharma. Sci.,* 1994, 4, 6, 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., *FEBS Letters,* 1987, 223, 42; Wu et al., *Cancer Research,* 1993, 53, 3765).

Various liposomes comprising one or more glycolipids are known in the art. Papahadjopoulos et al. (*Ann. N.Y. Acad. Sci.,* 1987, 507, 64) reported the ability of monosialoganglioside $G_{M1}$, galactocerebroside sulfate and phosphatidylinositol to improve blood half-lives of liposomes. These findings were expounded upon by Gabizon et al. (*Proc. Natl. Acad. Sci. U.S.A.,* 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

Many liposomes comprising lipids derivatized with one or more hydrophilic polymers, and methods of preparation thereof, are known in the art. Sunamoto et al. (*Bull. Chem. Soc. Jpn.,* 1980, 53, 2778) described liposomes comprising a nonionic detergent, 2C1215G, that contains a PEG moiety. Illum et al. (*FEBS Lett.,* 1984, 167, 79) noted that hydrophilic coating of polystyrene particles with polymeric glycols results in significantly enhanced blood half-lives. Synthetic phospholipids modified by the attachment of carboxylic groups of polyalkylene glycols (e.g., PEG) are described by Sears (U.S. Pat. Nos. 4,426,330 and 4,534,899). Klibanov et al. (*FEBS Lett.,* 1990, 268, 235) described experiments demonstrating that liposomes comprising phosphatidylethanolamine (PE) derivatized with PEG or PEG stearate have significant increases in blood circulation half-lives. Blume et al. (*Biochimica et Biophysica Acta,* 1990, 1029, 91) extended such observations to other PEG-derivatized phospholipids, e.g., DSPE-PEG, formed from the combination of distearoylphosphatidylethanolamine (DSPE) and PEG. Liposomes having covalently bound PEG moieties on their external surface are described in European Patent No. EP 0 445 131 B1 and WO 90/04384 to Fisher. Liposome compositions containing 1-20 mole percent of PE derivatized with PEG, and methods of use thereof, are described by Woodle et al. (U.S. Pat. Nos. 5,013,556 and 5,356,633) and Martin et al. (U.S. Pat. No. 5,213,804 and European Patent No. EP 0 496 813 B1). Liposomes comprising a number of other lipid-polymer conjugates are disclosed in WO 91/05545 and U.S. Pat. No. 5,225,212 (both to Martin et al.) and in WO 94/20073 (Zalipsky et al.). Liposomes comprising PEG-modified ceramide lipids are described in WO 96/10391 (Choi et al). U.S. Pat. No. 5,540,935 (Miyazaki et al.) and U.S. Pat. No. 5,556,948 (Tagawa et al.) describe PEG-containing liposomes that can be further derivatized with functional moieties on their surfaces.

A number of liposomes comprising nucleic acids are known in the art. WO 96/40062 to Thierry et al. discloses methods for encapsulating high molecular weight nucleic acids in liposomes. U.S. Pat. No. 5,264,221 to Tagawa et al. discloses protein-bonded liposomes and asserts that the contents of such liposomes may include a dsRNA. U.S. Pat. No. 5,665,710 to Rahman et al. describes certain methods of encapsulating oligodeoxynucleotides in liposomes. WO 97/04787 to Love et al. discloses liposomes comprising dsRNAs targeted to the raf gene.

Transfersomes are yet another type of liposomes, and are highly deformable lipid aggregates which are attractive candidates for drug delivery vehicles. Transfersomes may be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in *Pharmaceutical Dosage Forms*, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general, their HLB values range from 2 to about 18 depending on their structure.

Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in *Pharmaceutical Dosage Forms*, Marcel Dekker, Inc., New York, N.Y., 1988, p. 285).

Nucleic Acid Lipid Particles

In some embodiments, a VEGF-A dsRNA featured in the disclosure is fully encapsulated in the lipid formulation, e.g., to form a SPLP, pSPLP, SNALP, or other nucleic acid-lipid particle. SNALPs and SPLPs typically contain a cationic lipid, a non-cationic lipid, and a lipid that prevents aggregation of the particle (e.g., a PEG-lipid conjugate). SNALPs and SPLPs are extremely useful for systemic applications, as they exhibit extended circulation lifetimes following intravenous (i.v.) injection and accumulate at distal sites (e.g., sites physically separated from the administration site). SPLPs include "pSPLP," which include an encapsulated condensing agent-nucleic acid complex as set forth in PCT Publication No. WO 00/03683. The particles of the present disclosure typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present disclosure are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and PCT Publication No. WO 96/40964.

In some embodiments, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1.

The cationic lipid may be, for example, N,N-dioleyl-N,N-dimethylammonium chloride (DODAC), N,N-distearyl-N,N-dimethylammonium bromide (DDAB), N-(I-(2,3-dioleoyloxy)propyl)-N,N,N-trimethylammonium chloride (DOTAP), N-(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino)butanoate (MC3), 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1), or a mixture thereof. The cationic lipid may comprise from about 20 mol % to about 50 mol % or about 40 mol % of the total lipid present in the particle.

In some embodiments, the compound 2,2-Dilinoleyl-4-dimethylaminoethyl-[1,3]-dioxolane can be used to prepare lipid-siRNA nanoparticles. Synthesis of 2,2-Dilinoleyl dimethylaminoethyl-[1,3]-dioxolane is described in U.S. provisional patent application No. 61/107,998 filed on Oct. 23, 2008, which is herein incorporated by reference.

In some embodiments, the lipid-siRNA particle includes 40% 2, 2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The non-cationic lipid may be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid may be from about 5 mol % to about 90 mol %, about 10 mol %, or about 58 mol % if cholesterol is included, of the total lipid present in the particle.

The conjugated lipid that inhibits aggregation of particles may be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate may be, for example, a PEG-dilauryloxypropyl ($Ci_2$), a PEG-dimyristyloxypropyl ($Ci_4$), a PEG-dipalmityloxypropyl ($Ci_6$), or a PEG-distearyloxypropyl ($C]_8$). The conjugated lipid that prevents aggregation of particles may be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

In some embodiments, the iRNA is formulated in a lipid nanoparticle (LNP).

LNP01

In some embodiments, the lipidoid ND984HCl (MW 1487) (see U.S. patent application Ser. No. 12/056,230, filed Mar. 26, 2008, which is herein incorporated by reference), Cholesterol (Sigma-Aldrich), and PEG-Ceramide C16 (Avanti Polar Lipids) can be used to prepare lipid-dsRNA nanoparticles (e.g., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

Formula 1

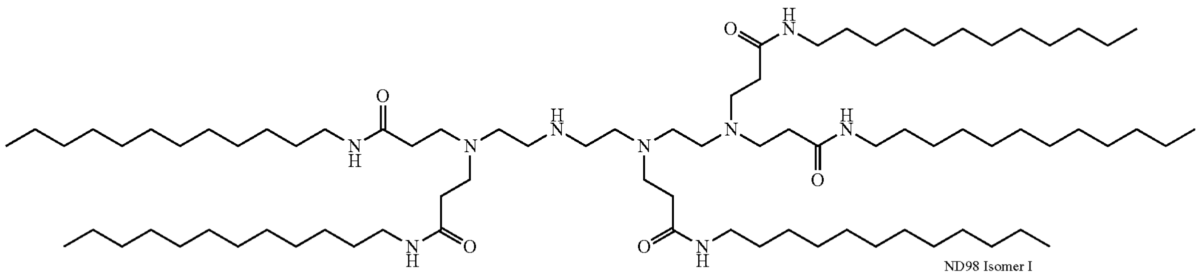

ND98 Isomer I

LNP01 formulations are described, e.g., in International Application Publication No. WO 2008/042973, which is hereby incorporated by reference.

Additional exemplary lipid-dsRNA formulations are provided in the following table.

TABLE 6

Exemplary lipid formulations

| | Cationic Lipid | cationic lipid/non-cationic lipid/cholesterol/PEG-lipid conjugate Lipid:siRNA ratio |
|---|---|---|
| SNALP | 1,2-Dilinolenyloxy-N,N - dimethylaminopropane (DLinDMA) | DLinDMA/DPPC/Cholesterol/PEG-cDMA (57.1/7.1/34.4/1.4) lipid:siRNA~7:1 |
| S-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA~7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA~6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA~11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |

TABLE 6-continued

| Exemplary lipid formulations | | |
|---|---|---|
| | Cationic Lipid | cationic lipid/non-cationic lipid/cholesterol/PEG-lipid conjugate Lipid:siRNA ratio |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (C12-200) | C12-200/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

DSPC: distearoylphosphatidylcholine
DPPC: dipalmitoylphosphatidylcholine
PEG-DMG: PEG-didimyristoyl glycerol (C14-PEG, or PEG-C14) (PEG with avg mol wt of 2000)
PEG-DSG: PEG-distyryl glycerol (C18-PEG, or PEG-C18) (PEG with avg mol wt of 2000)
PEG-cDMA: PEG-carbamoyl-1,2-dimyristyloxypropylamine (PEG with avg mol wt of 2000)

SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.

XTC comprising formulations are described, e.g., in U.S. Provisional Ser. No. 61/148,366, filed Jan. 29, 2009; U.S. Provisional Ser. No. 61/156,851, filed Mar. 2, 2009; U.S. Provisional Ser. No. 61/185,712, filed Jun. 10, 2009; U.S. Provisional Ser. No. 61/228,373, filed Jul. 24, 2009; U.S. Provisional Ser. No. 61/239,686, filed Sep. 3, 2009, and International Application No. PCT/US2010/022614, filed Jan. 29, 2010, which are hereby incorporated by reference.

MC3 comprising formulations are described, e.g., in U.S. Provisional Ser. No. 61/244,834, filed Sep. 22, 2009, U.S. Provisional Ser. No. 61/185,800, filed Jun. 10, 2009, and International Application No. PCT/US10/28224, filed Jun. 10, 2010, which are hereby incorporated by reference.

ALNY-100 comprising formulations are described, e.g., International patent application number PCT/US09/63933, filed on Nov. 10, 2009, which is hereby incorporated by reference.

C12-200 comprising formulations are described in U.S. Provisional Ser. No. 61/175,770, filed May 5, 2009 and International Application No. PCT/US10/33777, filed May 5, 2010, which are hereby incorporated by reference.

Synthesis of Cationic Lipids

Any of the compounds, e.g., cationic lipids and the like, used in the nucleic acid-lipid particles featured in the disclosure may be prepared by known organic synthesis techniques. All substituents are as defined below unless indicated otherwise.

"Alkyl" means a straight chain or branched, noncyclic or cyclic, saturated aliphatic hydrocarbon containing from 1 to 24 carbon atoms. Representative saturated straight chain alkyls include methyl, ethyl, n-propyl, n-butyl, n-pentyl, n-hexyl, and the like; while saturated branched alkyls include isopropyl, sec-butyl, isobutyl, tert-butyl, isopentyl, and the like. Representative saturated cyclic alkyls include cyclopropyl, cyclobutyl, cyclopentyl, cyclohexyl, and the like; while unsaturated cyclic alkyls include cyclopentenyl and cyclohexenyl, and the like.

"Alkenyl" means an alkyl, as defined above, containing at least one double bond between adjacent carbon atoms. Alkenyls include both cis and trans isomers. Representative straight chain and branched alkenyls include ethylenyl, propylenyl, 1-butenyl, 2-butenyl, isobutylenyl, 1-pentenyl, 2-pentenyl, 3-methyl-1-butenyl, 2-methyl-2-butenyl, 2,3-dimethyl-2-butenyl, and the like.

"Alkynyl" means any alkyl or alkenyl, as defined above, which additionally contains at least one triple bond between adjacent carbons. Representative straight chain and branched alkynyls include acetylenyl, propynyl, 1-butynyl, 2-butynyl, 1-pentynyl, 2-pentynyl, 3-methyl-1 butynyl, and the like.

"Acyl" means any alkyl, alkenyl, or alkynyl wherein the carbon at the point of attachment is substituted with an oxo group, as defined below. For example, —C(=O)alkyl, —C(=O)alkenyl, and —C(=O)alkynyl are acyl groups.

"Heterocycle" means a 5- to 7-membered monocyclic, or 7- to 10-membered bicyclic, heterocyclic ring which is either saturated, unsaturated, or aromatic, and which contains from 1 or 2 heteroatoms independently selected from nitrogen, oxygen and sulfur, and wherein the nitrogen and sulfur heteroatoms may be optionally oxidized, and the nitrogen heteroatom may be optionally quaternized, including bicyclic rings in which any of the above heterocycles are fused to a benzene ring. The heterocycle may be attached via any heteroatom or carbon atom. Heterocycles include heteroaryls as defined below. Heterocycles include morpholinyl, pyrrolidinonyl, pyrrolidinyl, piperidinyl, piperizynyl, hydantoinyl, valerolactamyl, oxiranyl, oxetanyl, tetrahydrofuranyl, tetrahydropyranyl, tetrahydropyridinyl, tetrahydropyrimidinyl, tetrahydrothiophenyl, tetrahydrothiopyranyl, tetrahydropyrimidinyl, tetrahydrothiophenyl, tetrahydrothiopyranyl, and the like.

The terms "optionally substituted alkyl", "optionally substituted alkenyl", "optionally substituted alkynyl", "optionally substituted acyl", and "optionally substituted heterocycle" means that, when substituted, at least one hydrogen atom is replaced with a substituent. In the case of an oxo substituent (=O) two hydrogen atoms are replaced. In this regard, substituents include oxo, halogen, heterocycle, —CN, —$OR^x$, —$NR^xR^y$, —$NR^xC(=O)R^y$, —$NR^xSO_2R^y$, —$C(=O)R^x$, —$C(=O)OR^x$, —$C(=O)NR^xR^y$, —$SO_nR^x$ and —$SO_nNR^xR^y$, wherein n is 0, 1 or 2, $R^x$ and $R^y$ are the same or different and independently hydrogen, alkyl or heterocycle, and each of said alkyl and heterocycle substituents may be further substituted with one or more of oxo, halogen, —OH, —CN, alkyl, —$OR^x$, heterocycle, —$NR^xR^y$, —$NR^xC(=O)R^y$, —$NR^xSO_2R^y$, —$C(=O)R^x$, —$C(=O)OR^x$, —$C(=O)NR^xR^y$, —$SO_nR^x$ and —$SO_n$-$NR^xR^y$.

"Halogen" means fluoro, chloro, bromo and iodo.

In some embodiments, the methods featured in the disclosure may require the use of protecting groups. Protecting group methodology is well known to those skilled in the art (see, for example, Protective Groups in Organic Synthesis, Green, T. W. et al., Wiley-Interscience, New York City, 1999). Briefly, protecting groups within the context of this disclosure are any group that reduces or eliminates unwanted reactivity of a functional group. A protecting group can be added to a functional group to mask its reactivity during certain reactions and then removed to reveal the original functional group. In some embodiments an "alcohol protecting group" is used. An "alcohol protecting group" is any group which decreases or eliminates unwanted reactivity of an alcohol functional group. Protecting groups can be added and removed using techniques well known in the art.

Synthesis of Formula A

In some embodiments, nucleic acid-lipid particles featured in the disclosure are formulated using a cationic lipid of formula A:

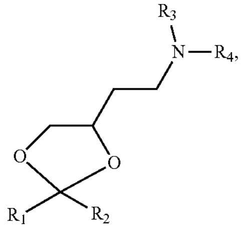

where R1 and R2 are independently alkyl, alkenyl or alkynyl, each can be optionally substituted, and R3 and R4 are independently lower alkyl or R3 and R4 can be taken together to form an optionally substituted heterocyclic ring. In some embodiments, the cationic lipid is XTC (2,2-Dilinoleyl-4-dimethylaminoethyl-[1,3]-dioxolane). In general, the lipid of formula A above may be made by the following Reaction Schemes 1 or 2, wherein all substituents are as defined above unless indicated otherwise.

Scheme 1

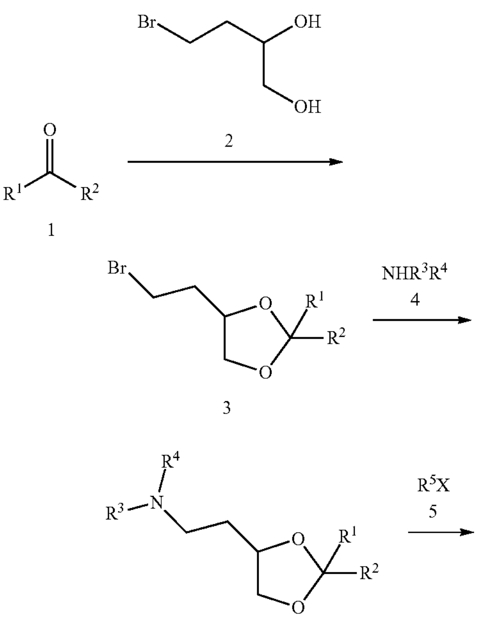

1

3

Formula A

-continued

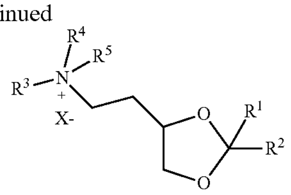

Lipid A, where $R_1$ and $R_2$ are independently alkyl, alkenyl or alkynyl, each can be optionally substituted, and $R_3$ and $R_4$ are independently lower alkyl or $R_3$ and $R_4$ can be taken together to form an optionally substituted heterocyclic ring, can be prepared according to Scheme 1. Ketone 1 and bromide 2 can be purchased or prepared according to methods known to those of ordinary skill in the art. Reaction of 1 and 2 yields ketal 3. Treatment of ketal 3 with amine 4 yields lipids of formula A. The lipids of formula A can be converted to the corresponding ammonium salt with an organic salt of formula 5, where X is anion counter ion selected from halogen, hydroxide, phosphate, sulfate, or the like.

Scheme 2

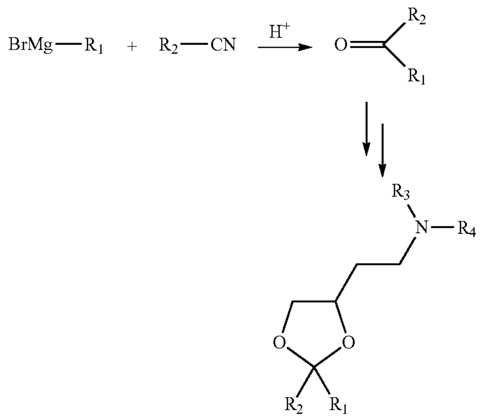

Alternatively, the ketone 1 starting material can be prepared according to Scheme 2. Grignard reagent 6 and cyanide 7 can be purchased or prepared according to methods known to those of ordinary skill in the art. Reaction of 6 and 7 yields ketone 1. Conversion of ketone 1 to the corresponding lipids of formula A is as described in Scheme 1.

Synthesis of MC3

Preparation of DLin-M-C3-DMA (i.e., (6Z,9Z,28Z,31Z)-heptatriaconta-6,9,28,31-tetraen-19-yl 4-(dimethylamino) butanoate) was as follows. A solution of (6Z,9Z,28Z,31Z)-heptatriaconta-6,9,28,31-tetraen-19-ol (0.53 g), 4-N,N-dimethylaminobutyric acid hydrochloride (0.51 g), 4-N,N-dimethylaminopyridine (0.61 g) and 1-ethyl-3-(3-dimethylaminopropyl)carbodiimide hydrochloride (0.53 g) in dichloromethane (5 mL) was stirred at room temperature overnight. The solution was washed with dilute hydrochloric acid followed by dilute aqueous sodium bicarbonate. The organic fractions were dried over anhydrous magnesium sulphate, filtered and the solvent removed on a rotovap. The residue was passed down a silica gel column (20 g) using a 1-5% methanol/dichloromethane elution gradient. Fractions containing the purified product were combined and the solvent removed, yielding a colorless oil (0.54 g).

Synthesis of ALNY-100

Synthesis of ketal 519 [ALNY-100] was performed using the following scheme 3:

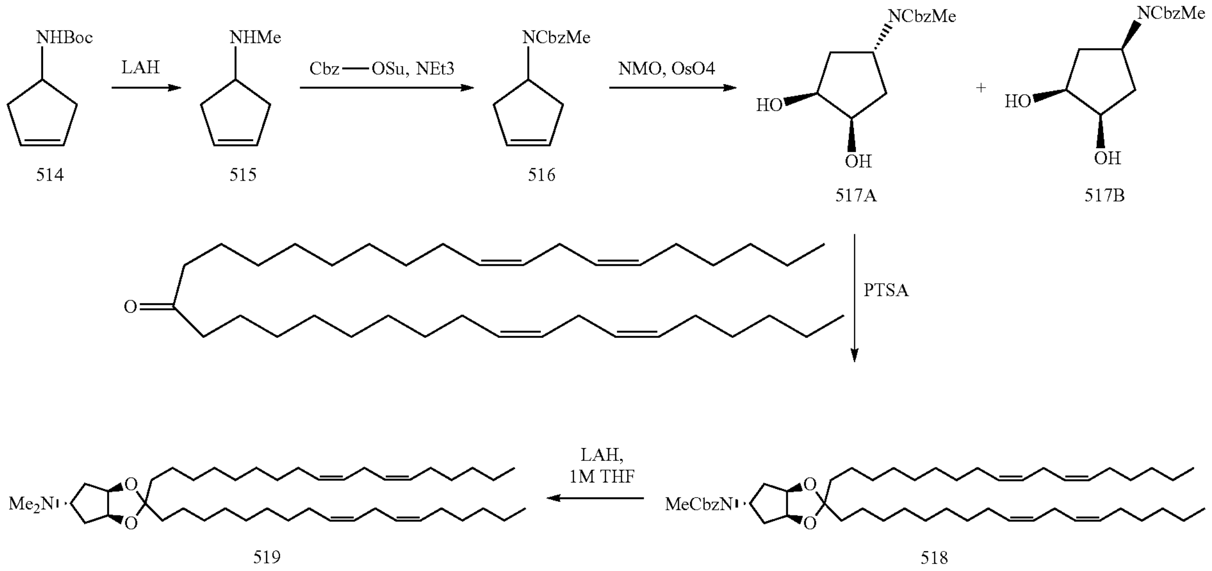

514 515 516 517A 517B 518 519

Synthesis of 515

To a stirred suspension of LiAlH4 (3.74 g, 0.09852 mol) in 200 ml anhydrous THF in a two neck RBF (1 L), was added a solution of 514 (10 g, 0.04926 mol) in 70 mL of THF slowly at 0 OC under nitrogen atmosphere. After complete addition, reaction mixture was warmed to room temperature and then heated to reflux for 4 h. Progress of the reaction was monitored by TLC. After completion of reaction (by TLC) the mixture was cooled to 0° C. and quenched with careful addition of saturated Na2SO4 solution. Reaction mixture was stirred for 4 h at room temperature and filtered off. Residue was washed well with THF. The filtrate and washings were mixed and diluted with 400 mL dioxane and 26 mL conc. HCl and stirred for 20 minutes at room temperature. The volatilities were stripped off under vacuum to furnish the hydrochloride salt of 515 as a white solid. Yield: 7.12 g 1H-NMR (DMSO, 400 MHz): δ=9.34 (broad, 2H), 5.68 (s, 2H), 3.74 (m, 1H), 2.66-2.60 (m, 2H), 2.50-2.45 (m, 5H).

Synthesis of 516

To a stirred solution of compound 515 in 100 mL dry DCM in a 250 mL two neck RBF, was added NEt3 (37.2 mL, 0.2669 mol) and cooled to 0° C. under nitrogen atmosphere. After a slow addition of N-(benzyloxy-carbonyloxy)-succinimide (20 g, 0.08007 mol) in 50 mL dry DCM, reaction mixture was allowed to warm to room temperature. After completion of the reaction (2-3 h by TLC) mixture was washed successively with 1N HCl solution (1×100 mL) and saturated $NaHCO_3$ solution (1×50 mL). The organic layer was then dried over anhyd. Na2SO4 and the solvent was evaporated to give crude material which was purified by silica gel column chromatography to get 516 as sticky mass. Yield: 11 g (89%). 1H-NMR (CDCl3, 400 MHz): δ=7.36-7.27 (m, 5H), 5.69 (s, 2H), 5.12 (s, 2H), 4.96 (br., 1H) 2.74 (s, 3H), 2.60 (m, 2H), 2.30-2.25 (m, 2H). LC-MS [M+H]-232.3 (96.94%).

Synthesis of 517A and 517B

The cyclopentene 516 (5 g, 0.02164 mol) was dissolved in a solution of 220 mL acetone and water (10:1) in a single neck 500 mL RBF and to it was added N-methyl morpholine-N-oxide (7.6 g, 0.06492 mol) followed by 4.2 mL of 7.6% solution of OsO4 (0.275 g, 0.00108 mol) in tert-butanol at room temperature. After completion of the reaction (~3 h), the mixture was quenched with addition of solid Na2SO3 and resulting mixture was stirred for 1.5 h at room temperature. Reaction mixture was diluted with DCM (300 mL) and washed with water (2×100 mL) followed by saturated $NaHCO_3$ (1×50 mL) solution, water (1×30 mL) and finally with brine (1×50 mL). Organic phase was dried over an·Na2SO4 and solvent was removed in vacuum. Silica gel column chromatographic purification of the crude material was afforded a mixture of diastereomers, which were separated by prep HPLC. Yield: -6 g crude 517A—Peak-1 (white solid), 5.13 g (96%). 1H-NMR (DMSO, 400 MHz): δ=7.39-7.31 (m, 5H), 5.04 (s, 2H), 4.78-4.73 (m, 1H), 4.48-4.47 (d, 2H), 3.94-3.93 (m, 2H), 2.71 (s, 3H), 1.72-1.67 (m, 4H). LC-MS-[M+H]-266.3, [M+NH4+]-283.5 present, HPLC-97.86%. Stereochemistry confirmed by X-ray.

Synthesis of 518

Using a procedure analogous to that described for the synthesis of compound 505, compound 518 (1.2 g, 41%) was obtained as a colorless oil. 1H-NMR (CDCl3, 400 MHz): δ=7.35-7.33 (m, 4H), 7.30-7.27 (m, 1H), 5.37-5.27 (m, 8H), 5.12 (s, 2H), 4.75 (m, 1H), 4.58-4.57 (m, 2H), 2.78-2.74 (m, 7H), 2.06-2.00 (m, 8H), 1.96-1.91 (m, 2H), 1.62 (m, 4H), 1.48 (m, 2H), 1.37-1.25 (br m, 36H), 0.87 (m, 6H). HPLC-98.65%.

General Procedure for the Synthesis of Compound 519

A solution of compound 518 (1 eq) in hexane (15 mL) was added in a drop-wise fashion to an ice-cold solution of LAH in THF (1 M, 2 eq). After complete addition, the mixture was heated at 40° C. over 0.5 h then cooled again on an ice bath. The mixture was carefully hydrolyzed with saturated aqueous Na2SO4 then filtered through celite and reduced to an oil. Column chromatography provided the pure 519 (1.3 g, 68%) which was obtained as a colorless oil. 13C NMR=130.2, 130.1 (×2), 127.9 (×3), 112.3, 79.3, 64.4, 44.7, 38.3, 35.4, 31.5, 29.9 (×2), 29.7, 29.6 (×2), 29.5 (×3), 29.3 (×2), 27.2 (×3), 25.6, 24.5, 23.3, 226, 14.1; Electrospray MS (+ve): Molecular weight for C44H80NO2 (M+H)+ Calc. 654.6, Found 654.6.

Formulations prepared by either the standard or extrusion-free method can be characterized in similar manners. For example, formulations are typically characterized by visual inspection. They should be whitish translucent solutions free from aggregates or sediment. Particle size and particle size distribution of lipid-nanoparticles can be measured by light scattering using, for example, a Malvern Zetasizer Nano ZS (Malvern, USA). Particles should be about 20-300 nm, such as 40-100 nm in size. The particle size distribution should be unimodal. The total dsRNA concentration in the formulation, as well as the entrapped fraction, is estimated using a dye exclusion assay. A sample of the formulated dsRNA can be incubated with an RNA-binding dye, such as Ribogreen (Molecular Probes) in the presence or absence of a formulation disrupting surfactant, e.g., 0.5% Triton-X100. The total dsRNA in the formulation can be determined by the signal from the sample containing the surfactant, relative to a standard curve. The entrapped fraction is determined by subtracting the "free" dsRNA content (as measured by the signal in the absence of surfactant) from the total dsRNA content. Percent entrapped dsRNA is typically >85%. For SNALP formulation, the particle size is at least 30 nm, at least 40 nm, at least 50 nm, at least 60 nm, at least 70 nm, at least 80 nm, at least 90 nm, at least 100 nm, at least 110 nm, and at least 120 nm. The suitable range is typically about at least 50 nm to about at least 110 nm, about at least 60 nm to about at least 100 nm, or about at least 80 nm to about at least 90 nm.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable. In some embodiments, oral formulations are those in which dsRNAs featured in the disclosure are administered in conjunction with one or more penetration enhancers surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the disclosure may be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly (ethylcyanoacrylate), poly(butylcyanoacrylate), poly (isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intravitreal, subretinal, transscleral, subconjunctival, retrobulbar, intracameral, intraventricular, or intrahepatic administration may include sterile aqueous solutions which may also contain buffers, diluents and other suitable additives such as, but not limited to, penetration enhancers, carrier compounds and other pharmaceutically acceptable carriers or excipients.

Pharmaceutical compositions of the present disclosure include, but are not limited to, solutions, emulsions, and liposome-containing formulations. These compositions may be generated from a variety of components that include, but are not limited to, preformed liquids, self-emulsifying solids and self-emulsifying semisolids.

The pharmaceutical formulations featured in the present disclosure, which may conveniently be presented in unit dosage form, may be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions featured in the present disclosure may be formulated into any of many possible dosage forms such as, but not limited to, tablets, capsules, gel capsules, liquid syrups, soft gels, suppositories, and enemas. The compositions may also be formulated as suspensions in aqueous, non-aqueous or mixed media. Aqueous suspensions may further contain substances which increase the viscosity of the suspension including, for example, sodium carboxymethylcellulose, sorbitol and/or dextran. The suspension may also contain stabilizers.

Additional Formulations

Emulsions

The compositions of the present disclosure may be prepared and formulated as emulsions. Emulsions are typically heterogeneous systems of one liquid dispersed in another in the form of droplets usually exceeding 0.1 μm in diameter (see e.g., Ansel's Pharmaceutical Dosage Forms and Drug Delivery Systems, Allen, LV., Popovich N G., and Ansel H C., 2004, Lippincott Williams & Wilkins (8th ed.), New York, N.Y.; Idson, in *Pharmaceutical Dosage Forms*, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in *Pharmaceutical Dosage Forms*, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions may be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions may contain additional components in addition to the dispersed phases, and the active drug which may be present as a solution in either the aqueous phase, oily phase or itself as a separate phase. Pharmaceutical excipients such as emulsifiers, stabilizers, dyes, and anti-oxidants may also be present in emulsions as needed. Pharmaceutical emulsions may also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise, a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion may be a semisolid or a solid, as is the case of emulsion-style ointment bases and creams. Other means of stabilizing emulsions entail the use of emulsifiers that may be incorporated into either phase of the emulsion. Emulsifiers may broadly be classified into four categories: synthetic surfactants, naturally occurring emulsifiers, absorption bases, and finely dispersed solids (see e.g., Ansel's *Pharmaceutical Dosage Forms and Drug Delivery Systems*, Allen, L V., Popovich N G., and Ansel H C., 2004, Lippincott Williams & Wilkins (8th ed.), New York, N.Y.; Idson, in *Pharmaceutical Dosage Forms*, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's *Pharmaceutical Dosage Forms and Drug Delivery Systems*, Allen, L V., Popovich N G., and Ansel H C., 2004, Lippincott Williams & Wilkins (8th ed.), New York, N.Y.; Rieger, in *Pharmaceutical Dosage Forms*, Lieberman, Rieger and Banker (Eds.), 1988, Marcel Dekker, Inc., New York, N.Y., volume 1, p. 285; Idson, in *Pharmaceutical Dosage Forms*, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants may be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in *Pharmaceutical Dosage Forms*, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in *Pharmaceutical Dosage Forms*, Lieberman, Rieger and Banker (Eds.), 1988, Marcel Dekker, Inc., New York, N.Y., volume 1, p. 335; Idson, in *Pharmaceutical Dosage Forms*, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that may readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used may be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's *Pharmaceutical Dosage Forms and Drug Delivery Systems*, Allen, L V., Popovich N G., and Ansel H C., 2004, Lippincott Williams & Wilkins (8th ed.), New York, N.Y.; Idson, in *Pharmaceutical Dosage Forms*, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's *Pharmaceutical Dosage Forms and Drug Delivery Systems*, Allen, L V., Popovich N G., and Ansel H C., 2004, Lippincott Williams & Wilkins (8th ed.), New York, N.Y.; Rosoff, in *Pharmaceutical Dosage Forms*, Lieberman, Rieger and Banker (Eds.), 1988, Marcel Dekker, Inc., New York, N.Y., volume 1, p. 245; Idson, in *Pharmaceutical Dosage Forms*, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

In some embodiments of the present disclosure, the compositions of iRNAs and nucleic acids are formulated as microemulsions. A microemulsion may be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in *Pharmaceutical Dosage Forms*, Lieberman, Rieger and Banker (Eds.), 1988, Marcel Dekker, Inc., New York, N.Y., volume 1, p. 245). Typically, microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotopically clear dispersions of two immiscible liquids that are stabilized by interfacial films of surface-active molecules (Leung and Shah, in: *Controlled Release of Drugs: Polymers and Aggregate Systems*, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's *Pharmaceutical Sciences*, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's *Pharmaceutical Dosage Forms and Drug Delivery Systems*, Allen, L V., Popovich N G., and Ansel H C., 2004, Lippincott Williams & Wilkins (8th ed.), New York, N.Y.; Rosoff, in *Pharmaceutical Dos-*

*age Forms*, Lieberman, Rieger and Banker (Eds.), 1988, Marcel Dekker, Inc., New York, N.Y., volume 1, p. 245; Block, in *Pharmaceutical Dosage Forms*, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions may, however, be prepared without the use of cosurfactants and alcohol-free self-emulsifying microemulsion systems are known in the art. The aqueous phase may typically be, but is not limited to, water, an aqueous solution of the drug, glycerol, PEG300, PEG400, polyglycerols, propylene glycols, and derivatives of ethylene glycol. The oil phase may include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., *Pharmaceutical Research,* 1994, 11, 1385-1390; Ritschel, *Meth. Find. Exp. Clin. Pharmacol.,* 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., *Pharmaceutical Research,* 1994, 11, 1385; Ho et al., *J. Pharm. Sci.,* 1996, 85, 138-143). Often microemulsions may form spontaneously when their components are brought together at ambient temperature. This may be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present disclosure will facilitate the increased systemic absorption of iRNAs and nucleic acids from the gastrointestinal tract, as well as improve the local cellular uptake of iRNAs and nucleic acids.

Microemulsions of the present disclosure may also contain additional components and additives such as sorbitan monostearate (Grill 3), Labrasol, and penetration enhancers to improve the properties of the formulation and to enhance the absorption of the iRNAs and nucleic acids of the present disclosure. Penetration enhancers used in the microemulsions of the present disclosure may be classified as belonging to one of five broad categories--surfactants, fatty acids, bile salts, chelating agents, and non-chelating non-surfactants (Lee et al., *Critical Reviews in Therapeutic Drug Carrier Systems,* 1991, p. 92). Each of these classes has been discussed above.

Penetration Enhancers

In some embodiments, the present disclosure employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs may cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers may be classified as belonging to one of five broad categories, i.e., surfactants, fatty acids, bile salts, chelating agents, and non-chelating non-surfactants (see e.g., Malmsten, M. Surfactants and polymers in drug delivery, *Informa Health Care*, New York, N.Y., 2002; Lee et al., *Critical Reviews in Therapeutic Drug Carrier Systems,* 1991, p. 92). Each of the above-mentioned classes of penetration enhancers are described below in greater detail.

Surfactants: In connection with the present disclosure, surfactants (or "surface-active agents") are chemical entities which, when dissolved in an aqueous solution, reduce the surface tension of the solution or the interfacial tension between the aqueous solution and another liquid, with the result that absorption of iRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, N.Y., 2002; Lee et al., *Critical Reviews in Therapeutic Drug Carrier Systems,* 1991, p. 92); and perfluorochemical emulsions, such as FC-43. Takahashi et al., *J. Pharm. Pharmacol.,* 1988, 40, 252).

Fatty acids: Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_{1-20}$ alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. *Enhancement in Drug Delivery*, CRC Press, Danvers, Mass., 2006; Lee et al., *Critical Reviews in Therapeutic Drug Carrier Systems,* 1991, p. 92; Muranishi, *Critical Reviews in Therapeutic Drug Carrier Systems,* 1990, 7, 1-33; El Hariri et al., *J. Pharm. Pharmacol.,* 1992, 44, 651-654).

Bile salts: The physiological role of bile includes the facilitation of dispersion and absorption of lipids and fat-soluble vitamins (see e.g., Malmsten, M. Surfactants and polymers in drug delivery, Informa Health Care, New York, N.Y., 2002; Brunton, Chapter 38 in: Goodman & Gilman's *The Pharmacological Basis of Therapeutics,* 9th Ed., Hardman et al. Eds., McGraw-Hill, New York, 1996, pp. 934-935). Various natural bile salts, and their synthetic derivatives, act as penetration enhancers. Thus, the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, N.Y., 2002; Lee et al., *Critical Reviews in Therapeutic Drug Carrier Systems,* 1991, page 92; Swinyard, Chapter 39 In: *Remington's Pharmaceutical Sciences,* 18th Ed., Gennaro, ed., Mack Publishing Co., Easton, Pa., 1990, pages 782-783; Muranishi, *Critical Reviews in Therapeutic Drug Carrier Systems,* 1990, 7, 1-33; Yamamoto et al., *J. Pharm. Exp. Ther.,* 1992, 263, 25; Yamashita et al., *J. Pharm. Sci.,* 1990, 79, 579-583).

Chelating Agents: Chelating agents, as used in connection with the present disclosure, can be defined as compounds that remove metallic ions from solution by forming complexes therewith, with the result that absorption of iRNAs through the mucosa is enhanced. With regards to their use as penetration enhancers in the present disclosure, chelating agents have the added advantage of also serving as DNase inhibitors, as most characterized DNA nucleases require a divalent metal ion for catalysis and are thus inhibited by chelating agents (Jarrett, *J. Chromatogr.,* 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of β-diketones (enamines)(see e.g., Katdare, A. et al., *Excipient development for pharmaceutical, biotechnology, and drug delivery*, CRC Press, Danvers, Mass., 2006; Lee et al., *Critical Reviews in Therapeutic Drug Carrier Systems,* 1991, page 92; Muranishi, *Critical Reviews in Therapeutic Drug Carrier Systems,* 1990, 7, 1-33; Buur et al., *J. Control Rel.,* 1990, 14, 43-51).

Non-chelating non-surfactants: As used herein, non-chelating non-surfactant penetration enhancing compounds can be defined as compounds that demonstrate insignificant activity as chelating agents or as surfactants but that nonetheless enhance absorption of iRNAs through the alimentary mucosa (see e.g., Muranishi, *Critical Reviews in Therapeutic Drug Carrier Systems,* 1990, 7, 1-33). This class of penetration enhancers include, for example, unsaturated cyclic ureas, 1-alkyl- and 1-alkenylazacyclo-alkanone derivatives (Lee et al., *Critical Reviews in Therapeutic Drug Carrier Systems,* 1991, page 92); and non-steroidal anti-inflammatory agents such as diclofenac sodium, indomethacin and phenylbutazone (Yamashita et al., *J. Pharm. Pharmacol.,* 1987, 39, 621-626).

Agents that enhance uptake of iRNAs at the cellular level may also be added to the pharmaceutical and other compositions of the present disclosure. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs. Examples of commercially available transfection reagents include, for example Lipofectamine™ (Invitrogen; Carlsbad, Calif.), Lipofectamine 2000™ (Invitrogen; Carlsbad, Calif.), 293Fectin™ (Invitrogen; Carlsbad, Calif.), Cellfectin™ (Invitrogen; Carlsbad, Calif.), DMRIE-C™ (Invitrogen; Carlsbad, Calif.), FreeStyle™ MAX (Invitrogen; Carlsbad, Calif.), Lipofectamine™ 2000 CD (Invitrogen; Carlsbad, Calif.), Lipofectamine™ (Invitrogen; Carlsbad, Calif.), RNAiMAX (Invitrogen; Carlsbad, Calif.), Oligofectamine™ (Invitrogen; Carlsbad, Calif.), Optifect™ (Invitrogen; Carlsbad, Calif.), X-tremeGENE Q2 Transfection Reagent (Roche; Grenzacherstrasse, Switzerland), DOTAP Liposomal Transfection Reagent (Grenzacherstrasse, Switzerland), DOSPER Liposomal Transfection Reagent (Grenzacherstrasse, Switzerland), or Fugene (Grenzacherstrasse, Switzerland), Transfectam® Reagent (Promega; Madison, Wis.), TransFast™ Transfection Reagent (Promega; Madison, Wis.), Tfx™-20 Reagent (Promega; Madison, Wis.), Tfx™-50 Reagent (Promega; Madison, Wis.), DreamFect™ (OZ Biosciences; Marseille, France), EcoTransfect (OZ Biosciences; Marseille, France), TransPassa D1 Transfection Reagent (New England Biolabs; Ipswich, Mass., USA), LyoVec™/LipoGen™ (Invivogen; San Diego, Calif., USA), PerFectin Transfection Reagent (Genlantis; San Diego, Calif., USA), NeuroPORTER Transfection Reagent (Genlantis; San Diego, Calif., USA), GenePORTER Transfection reagent (Genlantis; San Diego, Calif., USA), GenePORTER 2 Transfection reagent (Genlantis; San Diego, Calif., USA), Cytofectin Transfection Reagent (Genlantis; San Diego, Calif., USA), BaculoPORTER Transfection Reagent (Genlantis; San Diego, Calif., USA), TroganPORTER™ transfection Reagent (Genlantis; San Diego, Calif., USA), RiboFect (Bioline; Taunton, Mass., USA), PlasFect (Bioline; Taunton, Mass., USA), UniFECTOR (B-Bridge International; Mountain View, Calif., USA), SureFECTOR (B-Bridge International; Mountain View, Calif., USA), or HiFect™ (B-Bridge International, Mountain View, Calif., USA), among others.

Other agents may be utilized to enhance the penetration of the administered nucleic acids, including glycols such as ethylene glycol and propylene glycol, pyrrols such as 2-pyrrol, azones, and terpenes such as limonene and menthone.

Carriers

Certain compositions of the present disclosure also incorporate carrier compounds in the formulation. As used herein, "carrier compound" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., *DsRNA Res. Dev.,* 1995, 5, 115-121; Takakura et al., *DsRNA & Nucl. Acid Drug Dev.,* 1996, 6, 177-183).

Excipients

In contrast to a carrier compound, a pharmaceutical carrier or excipient may comprise, e.g., a pharmaceutically acceptable solvent, suspending agent or any other pharmacologically inert vehicle for delivering one or more nucleic acids to an animal. The excipient may be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present disclosure. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids may include sterile and non-sterile aqueous solutions, non-aqueous solutions in common solvents such as alcohols, or solutions of the nucleic acids in liquid or solid oil bases. The solutions may also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

Other Components

The compositions of the present disclosure may additionally contain other adjunct components conventionally found in pharmaceutical compositions, e.g., at their art-established usage levels. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present disclosure, such as dyes, flavoring agents, preservatives, antioxidants, opacifiers, thickening agents and stabilizers. However, such materials, when added, should not unduly interfere with the biological activities of the components of the compositions of the present disclosure. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions may contain substances that increase the viscosity of the suspension including, for example, sodium carboxymethylcellulose, sorbitol and/or dextran. The suspension may also contain stabilizers.

In some embodiments, pharmaceutical compositions featured in the disclosure include (a) one or more iRNA compounds and (b) one or more biologic agents which function by a non-RNAi mechanism. Examples of such biologic agents include agents that interfere with an interaction of VEGF-A and at least one VEGF-A binding partner.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are typical.

The data obtained from cell culture assays and animal studies can be used in formulating a range of dosage for use in humans. The dosage of compositions featured in the disclosure lies generally within a range of circulating concentrations that include the ED50 with little or no toxicity. The dosage may vary within this range depending upon the dosage form employed and the route of administration utilized. For any compound used in the methods featured in the disclosure, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

In addition to their administration, as discussed above, the iRNAs featured in the disclosure can be administered in combination with other known agents effective in treatment of diseases or disorders related to VEGF-A expression (e.g., an angiogenic ocular disorder). In any event, the administering physician can adjust the amount and timing of iRNA administration on the basis of results observed using standard measures of efficacy known in the art or described herein.

Methods of Treating Disorders Related to Expression of VEGF-A

The present disclosure relates to the use of an iRNA targeting VEGF-A to inhibit VEGF-A expression and/or to treat a disease, disorder, or pathological process that is related to VEGF-A expression (e.g., an angiogenic ocular disorder).

In some aspects, a method of treatment of a disorder related to expression of VEGF-A is provided, the method comprising administering an iRNA (e.g., a dsRNA) disclosed herein to a subject in need thereof. In some embodiments, the iRNA inhibits (decreases) VEGF-A expression.

In some embodiments, the subject is an animal that serves as a model for a disorder related to VEGF-A expression, e.g., an angiogenic ocular disorder, e.g., AMD, DR, DME, RVO, MEfRVO, CVO, ROP, or mCNV.

Angiogenic Ocular Disorders

In some embodiments, the disorder related to VEGF-A expression is an angiogenic ocular disorder. Non-limiting examples of angiogenic ocular disorders that are treatable using the methods described herein include AMD (including wet AMD, exudative AMD, etc.), RVO (e.g., CRVO, MEfRVO, retinopathy of prematurity (ROP), or branch retinal vein occlusion (BRVO), DME, CNV (e.g., myopic CNV), iris neovascularization, neovascular glaucoma, post-surgical fibrosis in glaucoma, proliferative retinopathy, proliferative vitreoretinopathy (PVR), optic disc neovascularization, corneal neovascularization, retinal neovascularization, vitreal neovascularization, pannus, pterygium, vascular retinopathy, von Hippel-Lindau disease, histoplasmosis, and diabetic retinopathies.

Clinical and pathological features of angiogenic ocular disorders include, but are not limited to, a reduction in visual acuity (e.g., characterized by floating spots, blurriness around the edges or center of field of vision (e.g., scotoma), metamorphopsia, and impaired color vision), increased leakage from the CNV, increased vascular permeability in the eye, collection of fluid or blood beneath the macula, abnormal ocular angiogenesis, and intraretinal hemorrhage.

In some embodiments, the subject with the angiogenic ocular disorder is less than 18 years old. In some embodiments, the subject with the angiogenic ocular disorder is an adult. In some embodiments, the subject has, or is identified as having, elevated levels of VEGF-A mRNA or protein relative to a reference level (e.g., a level of VEGF-A that is greater than a reference level).

In some embodiments, the angiogenic ocular disorder is diagnosed using analysis of a sample from the subject (e.g., an aqueous ocular fluid sample). In some embodiments, the sample is analyzed using a method selected from one or more of: fluorescent in situ hybridization (FISH), immunohistochemistry, VEGF-A immunoassay, electron microscopy, laser microdissection, and mass spectrometry. In some embodiments, angiogenic ocular disorder is diagnosed using any suitable diagnostic test or technique, e.g., angiography (e.g., fluorescein angiography or indocyanine green angiography), electroretinography, ultrasonography, pachymetry, optical coherence tomography (OCT), computed tomography (CT) and magnetic resonance imaging (MRI), tonometry, color vision testing, visual field testing, slit-lamp examination, ophthalmoscopy, and physical examination (e.g., to assess visual acuity (e.g., by fundoscopy or optical coherence tomography (OCT)).

Combination Therapies

In some embodiments, an iRNA (e.g., a dsRNA) disclosed herein is administered in combination with a second therapy (e.g., one or more additional therapies) known to be effective in treating a disorder related to VEGF-A expression (e.g., an angiogenic ocular disorder) or a symptom of such a disorder. The iRNA may be administered before, after, or concurrent with the second therapy. In some embodiments, the iRNA is administered before the second therapy. In some embodiments, the iRNA is administered after the second therapy. In some embodiments, the iRNA is administered concurrent with the second therapy.

The second therapy may be an additional therapeutic agent. The iRNA and the additional therapeutic agent can be administered in combination in the same composition or the additional therapeutic agent can be administered as part of a separate composition.

In some embodiments, the second therapy is a non-iRNA therapeutic agent that is effective to treat the disorder or symptoms of the disorder.

In some embodiments, the iRNA is administered in conjunction with a therapy.

Exemplary combination therapies include, but are not limited to, photodynamic therapy, photocoagulation therapy, a steroid, a non-steroidal anti-inflammatory agent, an anti-VEGF agent, and a vitrectomy.

In some embodiments, the anti-VEGF-A agent comprises a fusion protein. Exemplary anti-VEGF fusion proteins include, but are not limited to, aflibercept (EYLEA®). In some embodiments, the anti-VEGF-A fusion protein has the amino acid sequence of SDTGRPFVEMYSEIPEIIHMTE-GRELVIPCRVTSPNITVTLKKFPLDTLIPDGK RIIWDSRKG FIISNATYKEIGLLTCEATVNGHLYKT-NYLTHRQTNTIIDVVLSPSHGIELSVGEKLVLNC TARTELNVGIDFNWEYPSSKHQHKKLVNRD LKTQSGSEMKKFLSTLTIDGVTRSDQGLY TCAASSGLMTKKNSTFVRVHEKDKTHTCPPCPA-PELLGGPSVFLFPPKPKDTLMISRTPE VTCVVVDVSHEDPEVKFNWYVDGVEVHNAKTK PREEQYNSTYRVVSVLTVLHQDWL NGKEYKCKVSNKALPAPIEKTISKAKGQPREPQVYT LPPSRDELTKNQVSLTCLVKGFYP SDIAVEWESNGQ-PENNYKTTPPVLDSDGSFFLYSK-LTVDKSRWQQGNVFSCSVMHEAL HNHYTQKSLSL-SPG (SEQ ID NO: 1905), or a variant thereof having at least about 80%, 85%, 90%, 95%, or 99% sequence identity thereto.

In some embodiments, the anti-VEGF-A agent is an antibody or antigen-binding fragment thereof (e.g., an anti-VEGF-A antibody molecule). Exemplary anti-VEGF-A antibody molecules include, but are not limited to, ranibizumab (LUCENTIS®) and brolucizumab (BEOVU®). In some embodiments, an anti-VEGF-A antibody molecule competes for binding to VEGF-A with ranibizumab or brolucizumab.

In some embodiments, the anti-VEGF-A antibody molecules comprises one or more (e.g., all three) of a heavy chain complementarity determining region 1 (HCDR1), a heavy chain complementarity determining region 2 (HCDR2) and a heavy chain complementarity determining region 3 (HCDR3). In some embodiments, the anti-VEGF-A antibody molecules comprises one or more (e.g., all three) of a light chain complementarity determining region 1 (LCDR1), a light chain complementarity determining region 2 (LCDR2) and a light chain complementarity determining region 3 (LCDR3).

In some embodiments, the anti-VEGF-A antibody molecule comprises a VH comprising one or more (e.g., all three) of a heavy chain complementarity determining region 1 (HCDR1) of an anti-VEGF-A antibody molecule described herein, e.g., in Table 7, (or a sequence with no more than 1, 2, 3, or 4 mutations, e.g., substitutions, additions, or deletions), a HCDR2 of an anti-VEGF-A antibody or antibody fragment thereof described herein, e.g., in Table 7, (or a sequence with no more than 1, 2, 3, or 4 mutations, e.g., substitutions, additions, or deletions), and a HCDR3 of an anti-VEGF-A antibody molecule described herein, e.g., in Table 7, (or a sequence with no more than 1, 2, 3, or 4 mutations, e.g., substitutions, additions, or deletions).

In some embodiments, the anti-VEGF-A antibody molecule comprises a VL comprising one or more (e.g., all three) of a light chain complementarity determining region 1 (LCDR1) of an anti-VEGF-A antibody molecule described herein, e.g., in Table 7, (or a sequence with no more than 1, 2, 3, or 4 mutations, e.g., substitutions, additions, or deletions), a LCDR2 of an anti-VEGF-A antibody molecule described herein, e.g., in Table 7, (or a sequence with no more than 1, 2, 3, or 4 mutations, e.g., substitutions, additions, or deletions), and a LCDR3 of an anti-VEGF-A antibody molecule described herein, e.g., in Table 7, (or a sequence with no more than 1, 2, 3, or 4 mutations, e.g., substitutions, additions, or deletions).

In some embodiments, the anti-VEGF-A antibody molecule comprises a VH comprising an amino acid sequence of an anti-VEGF-A antibody molecule described herein, e.g., in Table 7, or an amino acid sequence having at least about 80%, 85%, 90%, 95%, or 99% sequence identity thereto. In some embodiments, the anti-VEGF-A antibody molecule comprises a VL comprising the amino acid sequence of an anti-VEGF-A antibody molecule described herein, e.g., in Table 7, or an amino acid sequence having at least about 80%, 85%, 90%, 95%, or 99% sequence identity thereto.

In some embodiments, the anti-VEGF-A antibody molecule comprises a VH comprising the amino acid sequence of an anti-VEGF-A antibody molecule described herein, e.g., in Table 7, (or an amino acid sequence having at least about 80%, 85%, 90%, 95%, or 99% sequence identity thereto) and a VL comprising the amino acid sequence of an anti-VEGF-A antibody molecule described herein, e.g., in Table 7, (or an amino acid sequence having at least about 80%, 85%, 90%, 95%, or 99% sequence identity thereto).

In one embodiment, the anti-VEGF-A antibody molecule comprises a scFv comprising a light chain and a heavy chain of an amino acid sequence of anti-VEGF-A antibody molecule described herein, e.g., in Table 7. In one embodiment, the anti-VEGF-A antibody molecule (e.g., an scFv) comprises: a light chain variable region comprising an amino acid sequence having at least one, two, or three modifications (e.g., substitutions) but not more than 30, 20, or 10 modifications (e.g., substitutions) of an amino acid sequence of a light chain variable region of an anti-VEGF-A antibody molecule described herein, e.g., in Table 7, or a sequence with 95-99% identity with an amino acid sequence of an anti-VEGF-A antibody molecule described herein, e.g., in Table 7; and/or a heavy chain variable region comprising an amino acid sequence having at least one, two, or three modifications (e.g., substitutions) but not more than 30, 20, or 10 modifications (e.g., substitutions) of an amino acid sequence of a heavy chain variable region of an anti-VEGF-A antibody molecule described herein, e.g., in Table 7, or a sequence with 95-99% identity to an amino acid sequence of an anti-VEGF-A antibody molecule described herein, e.g., in Table 7.

In one embodiment, the anti-VEGF-A antibody molecule is a scFv, and a light chain variable region comprising an amino acid sequence of anti-VEGF-A antibody molecule described herein, e.g., in Table 7, is attached to a heavy chain variable region comprising an amino acid sequence of an anti-VEGF-A antibody molecule described herein, via a linker, e.g., a linker described herein. In one embodiment, the anti-VEGF-A antibody molecule includes a $(Gly_4\text{-}Ser)n$ linker, wherein n is 1, 2, 3, 4, 5, or 6, preferably 3 or 4 (SEQ ID NO:1951). The light chain variable region and heavy chain variable region of a scFv can be, e.g., in any of the following orientations: light chain variable region-linker-heavy chain variable region or heavy chain variable region-linker-light chain variable region.

TABLE 7

Exemplary Anti-VEGF Antibody Molecule Sequences

| Description | SEQ ID NO. | Sequence |
|---|---|---|
| Brolucizumab Sequence | 1906 | MEIVMTQSPSTLSASVGDRVIITCQASEIIHSWLA<br>WYQQKPGKAPKLLIYLASTLASGVPSRFSGSGSG<br>AEFTLTISSLQPDDFATYYCQNVYLASTNGANFG<br>QGTKLTVLGGGGGSGGGGSGGGGSGGGGSEVQ<br>LVESGGGLVQPGGSLRLSCTASGFSLTDYYYMT<br>WVRQAPGKGLEWVGFIDPDDDPYYATWAKGRF<br>TISRDNSKNTLYLQMNSLRAEDTAVYYCAGGDH<br>NSGWGLDIWGQGTLVTVSS |
| Brolucizumab VH | 1907 | EVQLVESGGGLVQPGGSLRLSCTASGFSLTDYYY<br>MTWVRQAPGKGLEWVGFIDPDDDPYYATWAK<br>GRFTISRDNSKNTLYLQMNSLRAEDTAVYYCAG<br>GDHNSGWGLDIWGQGTLVTVSS |
| Brolucizumab VL | 1908 | MEIVMTQSPSTLSASVGDRVIITCQASEIIHSWLA<br>WYQQKPGKAPKLLIYLASTLASGVPSRFSGSGSG<br>AEFTLTISSLQPDDFATYYCQNVYLASTNGANFG<br>QGTKLTVLG |
| Brolucizumab Linker | 1909 | GGGGSGGGGSGGGGSGGGGS |
| Ranibizumab Heavy Chain | 1910 | EVQLVESGGGLVQPGGSLRLSCAASGYDFT**HYG**<br>**MN**WVRQAPGKGLEWVG**WINTYTGEPTYAADF**<br>**KR**RFTFSLDTSKSTAYLQMNSLRAEDTAVYYCA<br>K**YPYYYGTSHWYFDV**WGOGTLVTVSSASTKGP<br>SVFPLAPSSKSTSGGTAALGCLVKDYFPEPVTVS<br>WNSGALTSGVHTFPAVLQSSGLYSLSSVVTVPSS<br>SLGTQTYICNVNHKPSNTKVDKKVEPKSCDKTH<br>L |
| Ranibizumab Light Chain | 1911 | DIQLTQSPSSLSASVGDRVTITC**SASQDISNYLN**W<br>YQQKPGKAPKVLIY**FTSSLHS**GVPSRFSGSGSGT<br>DFTLTISSLQPEDFATYYC**QQYSTVPWT**FGQGT<br>KVEIKRTVAAPSVFIFPPSDEQLKSGTASVVCLLN<br>NFYPREAKVQWKVDNALQSGNSQESVTEQDSK<br>DSTYSLSSTLTLSKADYEKHKVYACEVTHQGLSS<br>PVTKSFNRGEC |

TABLE 7-continued

| Exemplary Anti-VEGF Antibody Molecule Sequences | | |
|---|---|---|
| Description | SEQ ID NO. | Sequence |
| Ranibizumab VH | 1912 | EVQLVESGGGLVQPGGSLRLSCAASGYDFT**HYGMN**WVRQAPGKGLEWVG**WINTYTGEPTYAADFKR**RFTFSLDTSKSTAYLQMNSLRAEDTAVYYCAK**YPYYYGTSHWYFDV**WGQGTLVTVSS |
| Ranibizumab VL | 1913 | DIQLTQSPSSLSASVGDRVTITC**SASQDISNYLN**WYQQKPGKAPKVLIY**FTSSLHS**GVPSRFSGSGSGTDFTLTISSLQPEDFATYYC**QQYSTVPWT**FGQGTKVEIK |

Note:
CDR sequences are bolded and underlined

Administration Dosages, Routes, and Timing

A subject (e.g., a human subject, e.g., a patient) can be administered a therapeutic amount of iRNA. The therapeutic amount can be, e.g., 0.05-50 mg/kg.

In some embodiments, the iRNA is formulated for delivery to a target organ, e.g., to the eye.

In some embodiments, the iRNA is formulated as a lipid formulation, e.g., an LNP formulation as described herein. In some such embodiments, the therapeutic amount is 0.05-5 mg/kg dsRNA. In some embodiments, the lipid formulation, e.g., LNP formulation, is administered intravenously.

In some embodiments, the iRNA is in the form of a GalNAc conjugate e.g., as described herein. In some such embodiments, the therapeutic amount is 0.5-50 mg dsRNA. In some embodiments, the e.g., GalNAc conjugate is administered subcutaneously.

In some embodiments, the administration is repeated, for example, on a regular basis, such as, daily, biweekly (i.e., every two weeks) for one month, two months, three months, four months, six months or longer. After an initial treatment regimen, the treatments can be administered on a less frequent basis. For example, after administration biweekly for three months, administration can be repeated once per month, for six months or a year or longer.

In some embodiments, the iRNA agent is administered in two or more doses. In some embodiments, the number or amount of subsequent doses is dependent on the achievement of a desired effect, e.g., to (a) inhibit angiogenesis; (b) inhibit or reduce the expression or activity of VEGF A; (c) inhibit choroidal neovascularization; (d) inhibit growth of new blood vessels in the choriocapillaris; (e) reduce retinal thickness; (f) increase visual acuity; or (g) reduce intraocular inflammation, or the achievement of a therapeutic or prophylactic effect, e.g., reduction or prevention of one or more symptoms associated with the disorder.

In some embodiments, the iRNA agent is administered according to a schedule. For example, the iRNA agent may be administered once per week, twice per week, three times per week, four times per week, or five times per week. In some embodiments, the schedule involves regularly spaced administrations, e.g., hourly, every four hours, every six hours, every eight hours, every twelve hours, daily, every 2 days, every 3 days, every 4 days, every 5 days, weekly, biweekly, or monthly. In some embodiments, the iRNA agent is administered at the frequency required to achieve a desired effect.

In some embodiments, the schedule involves closely spaced administrations followed by a longer period of time during which the agent is not administered. For example, the schedule may involve an initial set of doses that are administered in a relatively short period of time (e.g., about every 6 hours, about every 12 hours, about every 24 hours, about every 48 hours, or about every 72 hours) followed by a longer time period (e.g., about 1 week, about 2 weeks, about 3 weeks, about 4 weeks, about 5 weeks, about 6 weeks, about 7 weeks, or about 8 weeks) during which the iRNA agent is not administered. In some embodiments, the iRNA agent is initially administered hourly and is later administered at a longer interval (e.g., daily, weekly, biweekly, or monthly). In some embodiments, the iRNA agent is initially administered daily and is later administered at a longer interval (e.g., weekly, biweekly, or monthly). In certain embodiments, the longer interval increases over time or is determined based on the achievement of a desired effect.

Before administration of a full dose of the iRNA, patients can be administered a smaller dose, such as a 5% infusion dose, and monitored for adverse effects, such as an allergic reaction, or for elevated lipid levels or blood pressure. In another example, the patient can be monitored for unwanted effects.

Methods for Modulating Expression of VEGF-A

In some aspects, the disclosure provides a method for modulating (e.g., inhibiting or activating) the expression of VEGF-A, e.g., in a cell, in a tissue, or in a subject. In some embodiments, the cell or tissue is ex vivo, in vitro, or in vivo. In some embodiments, the cell or tissue is in the eye (e.g., retinal pigment epithelium (RPE), a retinal tissue, an astrocyte, a pericyte, a Müller cell, a ganglion cell, an endothelial cell, a photoreceptor cell, a retinal blood vessel (e.g., including endothelial cells and vascular smooth muscle cells), or choroid tissue, e.g., a choroid vessel). In some embodiments, the cell or tissue is in a subject (e.g., a mammal, such as, for example, a human). In some embodiments, the subject (e.g., the human) is at risk, or is diagnosed with a disorder related to expression of VEGF-A expression, as described herein.

In some embodiments, the method includes contacting the cell with an iRNA as described herein, in an amount effective to decrease the expression of VEGF-A in the cell. In some embodiments, contacting a cell with an RNAi agent includes contacting a cell in vitro with the RNAi agent or contacting a cell in vivo with the RNAi agent. In some embodiments, the RNAi agent is put into physical contact with the cell by the individual performing the method, or the RNAi agent may be put into a situation that will permit or cause it to subsequently come into contact with the cell. Contacting a cell in vitro may be done, for example, by incubating the cell with the RNAi agent. Contacting a cell in vivo may be done, for example, by injecting the RNAi agent into or near the tissue where the cell is located, or by injecting the RNAi agent into another area, e.g., ocular tissue. For example, the RNAi agent may contain or be coupled to a ligand, e.g., a lipophilic moiety or moieties as described below and further detailed, e.g., in PCT/US2019/031170 which is incorporated herein by reference in its entirety, including the passages therein describing lipophilic moieties, that directs or otherwise stabilizes the RNAi agent at a site of interest. Combinations of in vitro and in vivo methods of contacting are also possible. For example, a cell may also be contacted in vitro with an RNAi agent and subsequently transplanted into a subject.

The expression of VEGF-A may be assessed based on the level of expression of VEGF-A mRNA, VEGF-A protein, or the level of another parameter functionally linked to the level of expression of VEGF-A. In some embodiments, the expression of VEGF-A is inhibited by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95%. In some embodiments, the iRNA has an $IC_{50}$ in the range of 0.001-0.01 nM, 0.001-0.10 nM, 0.001-1.0 nM, 0.001-10 nM, 0.01-0.05 nM, 0.01-0.50 nM, 0.02-0.60 nM, 0.01-1.0 nM, 0.01-1.5 nM, 0.01-10 nM. The $IC_{50}$ value may be normalized relative to an appropriate control value, e.g., the $IC_{50}$ of a non-targeting iRNA.

In some embodiments, the method includes introducing into the cell or tissue an iRNA as described herein and maintaining the cell or tissue for a time sufficient to obtain degradation of the mRNA transcript of VEGF-A, thereby inhibiting the expression of VEGF-A in the cell or tissue.

In some embodiments, the method includes administering a composition described herein, e.g., a composition comprising an iRNA that binds VEGF-A, to the mammal such that expression of the target VEGF-A is decreased, such as for an extended duration, e.g., at least two, three, four days or more, e.g., one week, two weeks, three weeks, or four weeks or longer. In some embodiments, the decrease in expression of VEGF-A is detectable within 1 hour, 2 hours, 4 hours, 8 hours, 12 hours, or 24 hours of the first administration.

In some embodiments, the method includes administering a composition as described herein to a mammal such that expression of the target VEGF-A is increased by e.g., at least 10% compared to an untreated animal. In some embodiments, the activation of VEGF-A occurs over an extended duration, e.g., at least two, three, four days or more, e.g., one week, two weeks, three weeks, four weeks, or more. Without wishing to be bound by theory, an iRNA can activate VEGF-A expression by stabilizing the VEGF-A mRNA transcript, interacting with a promoter in the genome, or inhibiting an inhibitor of VEGF-A expression.

The iRNAs useful for the methods and compositions featured in the disclosure specifically target RNAs (primary or processed) of VEGF-A. Compositions and methods for inhibiting the expression of VEGF-A using iRNAs can be prepared and performed as described elsewhere herein.

In some embodiments, the method includes administering a composition containing an iRNA, where the iRNA includes a nucleotide sequence that is complementary to at least a part of an RNA transcript of VEGF-A of the subject, e.g., the mammal, e.g., the human, to be treated. The composition may be administered by any appropriate means known in the art including, but not limited to ocular (e.g., intraocular), topical, and intravenous administration.

In certain embodiments, the composition is administered intraocularly (e.g., by intravitreal administration, e.g., intravitreal injection; transscleral administration, e.g., transscleral injection; subconjunctival administration, e.g., subconjunctival injection; retrobulbar administration, e.g., retrobulbar injection; intracameral administration, e.g., intracameral injection; or subretinal administration, e.g., subretinal injection. In other embodiments, the composition is administered topically. In other embodiments, the composition is administered by intravenous infusion or injection.

In certain embodiments, the composition is administered by intravenous infusion or injection. In some such embodiments, the composition comprises a lipid formulated siRNA (e.g., an LNP formulation, such as an LNP11 formulation) for intravenous infusion.

Unless otherwise defined, all technical and scientific terms used herein have the same meaning as commonly understood by one of ordinary skill in the art to which this disclosure belongs. Although methods and materials similar or equivalent to those described herein can be used in the practice or testing of the iRNAs and methods featured in the disclosure, suitable methods and materials are described below. All publications, patent applications, patents, and other references mentioned herein are incorporated by reference in their entirety. In case of conflict, the present specification, including definitions, will control. In the event of a discrepancy between the recited positions of the duplexes presented herein and the alignment of the duplexes to the recited sequences, the alignment of the duplexes to the recited sequence will govern. In addition, the materials, methods, and examples are illustrative only and not intended to be limiting.

Specific Embodiments

1. A double stranded ribonucleic acid (dsRNA) agent for inhibiting expression of vascular endothelial growth factor A (VEGF-A), wherein the dsRNA agent comprises a sense strand and an antisense strand forming a double stranded region, wherein the sense strand comprises a nucleotide sequence comprising at least 15 contiguous nucleotides, with 0, 1, 2, or 3 mismatches, of a portion of a coding strand of human VEGF-A and the antisense strand comprises a nucleotide sequence comprising at least 15 contiguous nucleotides, with 0, 1, 2, or 3 mismatches, of the corresponding portion of a non-coding strand of human VEGF-A such that the sense strand is complementary to the at least 15 contiguous nucleotides in the antisense strand.

2. The dsRNA agent of embodiment 1, wherein the coding strand of human VEGF-A comprises the sequence SEQ ID NO: 1.

3. The dsRNA agent of embodiment 1 or 2, wherein the non-coding strand of human VEGF-A comprises the sequence of SEQ ID NO: 2.

4. A double stranded ribonucleic acid (dsRNA) agent for inhibiting expression of VEGF-A, wherein the dsRNA agent comprises a sense strand and an antisense strand forming a double stranded region, wherein the antisense strand comprises a nucleotide sequence comprising at least 15 contiguous nucleotides, with 0, 1, 2, or 3 mismatches, of a portion of nucleotide sequence of SEQ ID NO: 2 such that the sense strand is complementary to the at least 15 contiguous nucleotides in the antisense strand.

5. The dsRNA agent of embodiment 4, wherein the sense strand comprises a nucleotide sequence comprising at least 15 contiguous nucleotides, with 0, or 1, 2, or 3 mismatches, of the corresponding portion of the nucleotide sequence of SEQ ID NO: 1.

6. The dsRNA of any of the preceding embodiments, wherein the dsRNA agent comprises a sense strand and an antisense strand, wherein the antisense strand comprises a nucleotide sequence comprising at least 17 contiguous nucleotides, with 0, 1, 2, or 3 mismatches, of a portion of nucleotide sequence of SEQ ID NO: 2 such that the sense strand is complementary to the at least 17 contiguous nucleotides in the antisense strand.

7. The dsRNA of embodiment 6, wherein the sense strand comprises a nucleotide sequence comprising at least 17 contiguous nucleotides, with 0, or 1, 2, or 3 mismatches, of the corresponding portion of the nucleotide sequence of SEQ ID NO: 1.

8. The dsRNA of any of the preceding embodiments, wherein the dsRNA agent comprises a sense strand and an antisense strand, wherein the antisense strand comprises a nucleotide sequence comprising at least 19 contiguous nucleotides, with 0, 1, 2, or 3 mismatches, of a portion of nucleotide sequence of SEQ ID NO: 2 such that the sense strand is complementary to the at least 19 contiguous nucleotides in the antisense strand.

9. The dsRNA of embodiment 8, wherein the sense strand comprises a nucleotide sequence comprising at least 19 contiguous nucleotides, with 0, 1, 2, or 3 mismatches, of the corresponding portion of the nucleotide sequence of SEQ ID NO: 1.

10. The dsRNA of any of the preceding embodiments, wherein the dsRNA agent comprises a sense strand and an antisense strand, wherein the antisense strand comprises a nucleotide sequence comprising at least 21 contiguous nucleotides, with 0, 1, 2, or 3 mismatches, of a portion of nucleotide sequence of SEQ ID NO: 2 such that the sense strand is complementary to the at least 21 contiguous nucleotides in the antisense strand.

11. The dsRNA of embodiment 10, wherein the sense strand comprises a nucleotide sequence comprising at least 21 contiguous nucleotides, with 0, or 1, 2, or 3 mismatches, of the corresponding portion of the nucleotide sequence of SEQ ID NO: 1.

12. The dsRNA agent of any one of embodiments 1-11, wherein the portion of the sense strand is a portion within nucleotides 1855-1875, 1858-1878, 2178-2198, 2181-2201, 2944-2964, 2946-2966, 2952-2972, 3361-3381, or 3362-3382 of SEQ ID NO: 1.

13. The dsRNA agent of any one of embodiments 1-12, wherein the portion of the sense strand is a portion within a sense strand from a duplex chosen from AD-1020574 (CGACAGAACAGUCCUUAAUCA (SEQ ID NO: 4200)), AD-901094 (CAGAACAGUCCUUAAUCCAGA (SEQ ID NO: 4201)), AD-1020575 (CAGAACAGUCCUUAAUCCAGA (SEQ ID NO: 4202)), AD-901100 (AACAGUGCUAAUGUUAUUGGA (SEQ ID NO: 4203)), AD-901101 (AGUGCUAAUGUUAUUGGUGUA (SEQ ID NO: 4204)), AD-901113 (GAGAAAGUGUUUUAUAUACGA (SEQ ID NO: 4205)), AD-901123 (AAAAUAGACAUUGCUAUUCUA (SEQ ID NO: 4206)), AD-901124 (AAAUAGACAUUGCUAUUCUGA (SEQ ID NO: 4207)), AD-901158 (GAAAGUGUUUUAUAUACGGUA (SEQ ID NO: 4208)), AD-901159 (GUUUUAUAUACGGUACUUAUA (SEQ ID NO: 4209)), AD-1020573 (AGUGCUAATGUUAUUGGUGUA (SEQ ID NO: 4210)), or AD-1023143 (AAAAUAGACATUGCUAUUCUA (SEQ ID NO: 4211)).

14. The dsRNA agent of any one of embodiments 1-13, wherein the portion of the sense strand is a sense strand chosen from the sense strands of AD-1020574 (CGACAGAACAGUCCUUAAUCA (SEQ ID NO: 4200)), AD-901094 (CAGAACAGUCCUUAAUCCAGA (SEQ ID NO: 4201)), AD-1020575 (CAGAACAGUCCUUAAUCCAGA (SEQ ID NO: 4202)), AD-901100 (AACAGUGCUAAUGUUAUUGGA (SEQ ID NO: 4203)), AD-901101 (AGUGCUAAUGUUAUUGGUGUA (SEQ ID NO: 4204)), AD-901113 (GAGAAAGUGUUUUAUAUACGA (SEQ ID NO: 4205)), AD-901123 (AAAAUAGACAUUGCUAUUCUA (SEQ ID NO: 4206)), AD-901124 (AAAUAGACAUUGCUAUUCUGA (SEQ ID NO: 4207)), AD-901158 (GAAAGUGUUUUAUAUACGGUA (SEQ ID NO: 4208)), AD-901159 (GUUUUAUAUACGGUACUUAUA (SEQ ID NO: 4209)), AD-1020573 (AGUGCUAATGUUAUUGGUGUA (SEQ ID NO: 4210)), or AD-1023143 (AAAAUAGACATUGCUAUUCUA (SEQ ID NO: 4211)).

15. The dsRNA of any one of embodiments 1-14, wherein the portion of the antisense strand is a portion within an antisense strand from a duplex chosen from AD-1020574 (UGAUUAAGGACUGUUCUGUCGAU (SEQ ID NO: 4212)), AD-901094 (UCUGGAUUAAGGACUGUUCUGUC (SEQ ID NO: 4213)), AD-1020575 (UCUGGATUAAGGACUGUUCUGUC (SEQ ID NO: 4214)), AD-901100 (UCCAAUAACAUUAGCACUGUUAA (SEQ ID NO: 4215)), AD-901101 (UACACCAAUAACAUUAGCACUGU (SEQ ID NO: 4216)), AD-901113 (UCGUAUAUAAAACACUUUCUCUU (SEQ ID NO: 4217)), AD-901123 (UAGAAUAGCAAUGUCUAUUUUAU (SEQ ID NO: 4218)), AD-901124 (UCAGAAUAGCAAUGUCUAUUUUA (SEQ ID NO: 4219)), AD-901158 (UACCGUAUAUAAAACACUUUCUC (SEQ ID NO: 4220)), AD-901159 (UAUAAGUACCGUAUAUAAAACAC (SEQ ID NO: 4221)), AD-1020573 (UACACCAAUAACATUAGCACUGU (SEQ ID NO: 4222)), or AD-1023143 (UAGAAUAGCAATGTCTAUUUUAU (SEQ ID NO: 4223)).

16. The dsRNA of any one of embodiments 1-15, wherein the portion of the antisense strand is an antisense strand chosen the antisense strands of AD-1020574 (UGAUUAAGGACUGUUCUGUCGAU (SEQ ID NO: 4212)), AD-901094 (UCUGGAUUAAGGACUGUUCUGUC (SEQ ID NO: 4213)), AD-1020575 (UCUGGATUAAGGACUGUUCUGUC (SEQ ID NO: 4214)), AD-901100 (UCCAAUAACAUUAGCACUGUUAA (SEQ ID NO: 4215)), AD-901101 (UACACCAAUAACAUUAGCACUGU (SEQ ID NO: 4216)), AD-901113 (UCGUAUAUAAAACACUUUCUCUU (SEQ ID NO: 4217)), AD-901123 (UAGAAUAGCAAUGUCUAUUUUAU (SEQ ID NO: 4218)), AD-901124 (UCAGAAUAGCAAUGUCUAUUUUA (SEQ ID NO: 4219)), AD-901158 (UACCGUAUAUAAAACACUUUCUC (SEQ ID NO: 4220)), AD-901159 (UAUAAGUACCGUAUAUAAAACAC (SEQ ID NO: 4221)), AD-1020573 (UACACCAAUAACATUAGCACUGU (SEQ ID NO: 4222)), or AD-1023143 (UAGAAUAGCAATGTCTAUUUUAU (SEQ ID NO: 4223)).

17. The dsRNA of any one of embodiments 1-16, wherein the sense strand and the antisense strand comprise nucleotide sequences of the paired sense strand and antisense strand of a duplex selected from AD-1020574 (SEQ ID NO: 4200 and 4212), AD-901094 (SEQ ID NO: 4201 and 4213), AD-1020575 (SEQ ID NO: 4202 and 4214), AD-901100 (SEQ ID NO: 4203 and 4215), AD-901101 (SEQ ID NO: 4204 and 4216), AD-901113 (SEQ ID NO: 4205 and 4217), AD-901123 (SEQ ID NO: 4206 and 4218), AD-901124 (SEQ ID NO: 4207 and 4219), AD-901158 (SEQ ID NO: 4208 and 4220), AD-901159 (SEQ ID NO: 4209 and 4221), AD-1020573 (SEQ ID NO: 4210 and 4222), or AD-1023143 (SEQ ID NO: 4211 and 4223).

18. The dsRNA agent of any one of embodiments 1-11, wherein the portion of the sense strand is a portion within a sense strand from a duplex chosen from AD-953374 (SEQ ID NO: 813), AD-953504 (SEQ ID NO: 1297), AD-953481 (SEQ ID NO: 1298), AD-953351 (SEQ ID NO: 800), AD-901356 (SEQ ID NO: 261), AD-953344 (SEQ ID NO: 787), AD-901355 (SEQ ID NO: 262), AD-953410 (SEQ ID NO: 845), AD-953363 (SEQ ID NO: 779), AD-953411 (SEQ ID NO: 844), AD-953350 (SEQ ID NO: 784), or AD-953375 (SEQ ID NO: 790).

19. The dsRNA agent of any one of embodiments 1-11 or 18, wherein the portion of the sense strand is a sense strand chosen from the sense strands of AD-953374 (SEQ ID NO: 813), AD-953504 (SEQ ID NO: 1297), AD-953481 (SEQ ID NO: 1298), AD-953351 (SEQ ID NO: 800), AD-901356 (SEQ ID NO: 261), AD-953344 (SEQ ID NO: 787), AD-901355 (SEQ ID NO: 262), AD-953410 (SEQ ID NO: 845), AD-953363 (SEQ ID NO: 779), AD-953411 (SEQ ID NO: 844), AD-953350 (SEQ ID NO: 784), or AD-953375 (SEQ ID NO: 790).

20. The dsRNA of any one of embodiments 1-11 or 18-19, wherein the portion of the antisense strand is a portion within an antisense strand from a duplex chosen from AD-953374 (SEQ ID NO: 943), AD-953504 (SEQ ID NO: 1427), AD-953481 (SEQ ID NO: 1428), AD-953351 (SEQ ID NO: 930), AD-901356 (SEQ ID NO: 390), AD-953344 (SEQ ID NO: 917), AD-901355 (SEQ ID NO: 391), AD-953410 (SEQ ID NO: 975), AD-953363 (SEQ ID NO: 909), AD-953411 (SEQ ID NO: 974), AD-953350 (SEQ ID NO: 914), or AD-953375 (SEQ ID NO: 920).

21. The dsRNA of any one of embodiments 1-11 or 18-20, wherein the portion of the antisense strand is an antisense strand chosen from AD-953374 (SEQ ID NO: 943), AD-953504 (SEQ ID NO: 1427), AD-953481 (SEQ ID NO: 1428), AD-953351 (SEQ ID NO: 930), AD-901356 (SEQ ID NO: 390), AD-953344 (SEQ ID NO: 917), AD-901355 (SEQ ID NO: 391), AD-953410 (SEQ ID NO: 975), AD-953363 (SEQ ID NO: 909), AD-953411 (SEQ ID NO: 974), AD-953350 (SEQ ID NO: 914), or AD-953375 (SEQ ID NO: 920).

22. The dsRNA of any one of embodiments 1-11, or 18-21 wherein the sense strand and the antisense strand of comprise the nucleotide sequences of the paired sense strand and antisense strand of a duplex selected from AD-953374 (SEQ ID NO: 813 and 943), AD-953504 (SEQ ID NO: 1297 and 1427), AD-953481 (SEQ ID NO: 1298 and 1428), AD-953351 (SEQ ID NO: 800 and 930), AD-901356 (SEQ ID NO: 261 and 390), AD-953344 (SEQ ID NO: 787 and 917), AD-901355 (SEQ ID NO: 262 and 391), AD-953410 (SEQ ID NO: 845 and 975), AD-953363 (SEQ ID NO: 779 and 909), AD-953411 (SEQ ID NO: 844 and 974), AD-953350 (SEQ ID NO: 784 and 914), or AD-953375 (SEQ ID NO: 790 and 920).

23. The dsRNA agent of any one of the preceding embodiments, wherein the portion of the sense strand is a portion within a sense strand in any one of Tables 2A, 2B, 3A, 3B, 4A, 4B, 5A, 5B, 8A, 8B, 10A, 10B, 12, 13, 14, 18A and 18B.

24. The dsRNA agent of any one of the preceding embodiments, wherein the portion of the antisense strand is a portion within an antisense strand in any one of Tables 2A, 2B, 3A, 3B, 4A, 4B, 5A, 5B, 8A, 8B, 10A, 10B, 12, 13, 14, 18A and 18B.

25. The dsRNA agent of any of the preceding embodiments, wherein the antisense strand comprises a nucleotide sequence comprising at least 15 contiguous nucleotides, with 0, 1, 2, or 3 mismatches, from one of the antisense sequences listed in any one of Tables 2A, 2B, 3A, 3B, 4A, 4B, 5A, 5B, 8A, 8B, 10A, 10B, 12, 13, 14, 18A and 18B.

26. The dsRNA agent of any of the preceding embodiments, wherein the sense strand comprises a nucleotide sequence comprising at least 15 contiguous nucleotides, with 0, 1, 2, or 3 mismatches, from a sense sequence listed in any one of Tables 2A, 2B, 3A, 3B, 4A, 4B, 5A, 5B, 8A, 8B, 10A, 10B, 12, 13, 14, 18A and 18B that corresponds to the antisense sequence.

27. The dsRNA agent of any of the preceding embodiments, wherein the antisense strand comprises a nucleotide sequence comprising at least 17 contiguous nucleotides, with 0, 1, 2, or 3 mismatches, from one of the antisense sequences listed in any one of Tables 2A, 2B, 3A, 3B, 4A, 4B, 5A, 5B, 8A, 8B, 10A, 10B, 12, 13, 14, 18A and 18B.

28. The dsRNA agent of any of the preceding embodiments, wherein the sense strand comprises a nucleotide sequence comprising at least 17 contiguous nucleotides, with 0, 1, 2, or 3 mismatches, from a sense sequence listed in any one of Tables 2A, 2B, 3A, 3B, 4A, 4B, 5A, 5B, 8A, 8B, 10A, 10B, 12, 13, 14, 18A and 18B that corresponds to the antisense sequence.

29. The dsRNA agent of any of the preceding embodiments, wherein the antisense strand comprises a nucleotide sequence comprising at least 19 contiguous nucleotides, with 0,1, 2, or 3 mismatches, from one of the antisense sequences listed in any one of Tables 2A, 2B, 3A, 3B, 4A, 4B, 5A, 5B, 8A, 8B, 10A, 10B, 12, 13, 14, 18A and 18B.

30. The dsRNA agent of any of the preceding embodiments, wherein the sense strand comprises a nucleotide sequence comprising at least 19 contiguous nucleotides, with 0, 1, 2, or 3 mismatches, from a sense sequence listed in any one of Tables 2A, 2B, 3A, 3B, 4A, 4B, 5A, 5B, 8A, 8B, 10A, 10B, 12, 13, 14, 18A and 18B that corresponds to the antisense sequence.

31. The dsRNA agent of any of the preceding embodiments, wherein the antisense strand comprises a nucleotide sequence comprising at least 21 contiguous nucleotides, with 0,1, 2, or 3 mismatches, from one of the antisense sequences listed in any one of Tables 2A, 2B, 3A, 3B, 4A, 4B, 5A, 5B, 8A, 8B, 10A, 10B, 12, 13, 14, 18A and 18B.

32. The dsRNA agent of any of the preceding embodiments, wherein the sense strand comprises a nucleotide sequence comprising at least 21 contiguous nucleotides, with 0, 1, 2, or 3 mismatches, from a sense sequence listed in any one of Tables 2A, 2B, 3A, 3B, 4A, 4B, 5A, 5B, 8A, 8B, 10A, 10B, 12, 13, 14, 18A and 18B that corresponds to the antisense sequence.

33. A double-stranded ribonucleic acid (dsRNA) agent for inhibiting expression of VEGF-A, wherein the dsRNA agent comprises a sense strand and an antisense strand forming a double-stranded region, wherein the antisense strand comprises a nucleotide sequence of an antisense sequence listed in any one of Tables 2A, 2B, 3A, 3B, 4A, 4B, 5A, 5B, 8A, 8B, 10A, 10B, 12, 13, 14, 18A and 18B, and the sense strand comprises a nucleotide sequence of a sense sequence listed in any one of Tables 2A, 2B, 3A, 3B, 4A, 4B, 5A, 5B, 8A, 8B, 10A, 10B, 12, 13, 14, 18A and 18B that corresponds to the antisense sequence.

34. The dsRNA agent of embodiment 33, wherein the antisense strand comprises a nucleotide sequence of an antisense sequence listed in Table 2A, and the sense strand comprises a nucleotide sequence of a sense sequence listed in Table 2A that corresponds to the antisense sequence.

35. The dsRNA agent of embodiment 33, wherein the antisense strand comprises a nucleotide sequence of an antisense sequence listed in Table 3A, and the sense strand comprises a nucleotide sequence of a sense sequence listed in Table 3A that corresponds to the antisense sequence.

36. The dsRNA agent of embodiment 33, wherein the antisense strand comprises a nucleotide sequence of an antisense sequence listed in Table 4A, and the sense strand comprises a nucleotide sequence of a sense sequence listed in Table 4A that corresponds to the antisense sequence.

37. The dsRNA agent of embodiment 33, wherein the antisense strand comprises a nucleotide sequence of an antisense sequence listed in Table 18A, and the sense strand comprises a nucleotide sequence of a sense sequence listed in Table 18A that corresponds to the antisense sequence.

38. The dsRNA agent of any one of embodiments 33 or 37, wherein the dsRNA agent is AD-1020574, AD-901094, AD-1020575, AD-901100, AD-901101, AD-901113, AD-901123, AD-901124, AD-901158, AD-901159, AD-1020573, or AD-1023143.

39. The dsRNA agent of any one of embodiments 33 or 37-38, comprising:

(i) the sense strand comprises the sequence and all the modifications of SEQ ID NO: 4164, and the antisense strand comprises the sequence and all the modifications of SEQ ID NO: 4176;

(ii) the sense strand comprises the sequence and all the modifications of SEQ ID NO: 1465, and the antisense strand comprises the sequence and all the modifications of SEQ ID NO: 4177;

(iii) the sense strand comprises the sequence and all the modifications of SEQ ID NO: 1466, and the antisense strand comprises the sequence and all the modifications of SEQ ID NO: 4178;

(iv) the sense strand comprises the sequence and all the modifications of SEQ ID NO: 1467, and the antisense strand comprises the sequence and all the modifications of SEQ ID NO: 4179;

(v) the sense strand comprises the sequence and all the modifications of SEQ ID NO: 1468, and the antisense strand comprises the sequence and all the modifications of SEQ ID NO: 4180;

(vi) the sense strand comprises the sequence and all the modifications of SEQ ID NO: 1469, and the antisense strand comprises the sequence and all the modifications of SEQ ID NO: 4181;

(vii) the sense strand comprises the sequence and all the modifications of SEQ ID NO: 1470, and the antisense strand comprises the sequence and all the modifications of SEQ ID NO: 4182;

(viii) the sense strand comprises the sequence and all the modifications of SEQ ID NO: 1471, and the antisense strand comprises the sequence and all the modifications of SEQ ID NO: 4183;

(ix) the sense strand comprises the sequence and all the modifications of SEQ ID NO: 1472, and the antisense strand comprises the sequence and all the modifications of SEQ ID NO: 4184;

(x) the sense strand comprises the sequence and all the modifications of SEQ ID NO: 1473, and the antisense strand comprises the sequence and all the modifications of SEQ ID NO: 4185;

(xi) the sense strand comprises the sequence and all the modifications of SEQ ID NO: 1474, and the antisense strand comprises the sequence and all the modifications of SEQ ID NO: 4186; or (xii) the sense strand comprises the sequence and all the modifications of SEQ ID NO: 1475, and the antisense strand comprises the sequence and all the modifications of SEQ ID NO: 4187.

40. The dsRNA agent of any one of embodiments 33-36, wherein the dsRNA agent is AD-953374, AD-953504, AD-953481, AD-953351, AD-901356, AD-953344, AD-901355, AD-953410, AD-953363, AD-953411, AD-953350, or AD-953375.

41. The dsRNA agent of any one of embodiments 33-36 or 40, comprising:

(i) the sense strand comprises the sequence and all the modifications of SEQ ID NO: 553, and the antisense strand comprises the sequence and all the modifications of SEQ ID NO: 683;

(ii) the sense strand comprises the sequence and all the modifications of SEQ ID NO: 1037, and the antisense strand comprises the sequence and all the modifications of SEQ ID NO: 1167;

(iii) the sense strand comprises the sequence and all the modifications of SEQ ID NO: 1038, and the antisense strand comprises the sequence and all the modifications of SEQ ID NO: 1168;

(iv) the sense strand comprises the sequence and all the modifications of SEQ ID NO: 540, and the antisense strand comprises the sequence and all the modifications of SEQ ID NO: 670;

(v) the sense strand comprises the sequence and all the modifications of SEQ ID NO: 3, and the antisense strand comprises the sequence and all the modifications of SEQ ID NO: 132;

(vi) the sense strand comprises the sequence and all the modifications of SEQ ID NO: 527, and the antisense strand comprises the sequence and all the modifications of SEQ ID NO: 657;

(vii) the sense strand comprises the sequence and all the modifications of SEQ ID NO: 4, and the antisense strand comprises the sequence and all the modifications of SEQ ID NO: 133;

(viii) the sense strand comprises the sequence and all the modifications of SEQ ID NO: 585, and the antisense strand comprises the sequence and all the modifications of SEQ ID NO: 715;

(ix) the sense strand comprises the sequence and all the modifications of SEQ ID NO: 519, and the antisense strand comprises the sequence and all the modifications of SEQ ID NO: 649;

(x) the sense strand comprises the sequence and all the modifications of SEQ ID NO: 584, and the antisense strand comprises the sequence and all the modifications of SEQ ID NO: 714;

(xi) the sense strand comprises the sequence and all the modifications of SEQ ID NO: 524, and the antisense strand comprises the sequence and all the modifications of SEQ ID NO: 654; or (xii) the sense strand comprises the sequence and all the modifications of SEQ ID NO: 530, and the antisense strand comprises the sequence and all the modifications of SEQ ID NO: 660.

42. The dsRNA agent of any of the preceding embodiments, wherein the sense strand is at least 23 nucleotides in length, e.g., 23-30 nucleotides in length.

43. The dsRNA agent of any of the preceding embodiments, wherein at least one of the sense strand and the antisense strand is conjugated to one or more lipophilic moieties.

44. The dsRNA agent of embodiment 43, wherein the lipophilic moiety is conjugated to one or more positions in the double stranded region of the dsRNA agent.

45. The dsRNA agent of embodiment 43 or 44, wherein the lipophilic moiety is conjugated via a linker or carrier.

46. The dsRNA agent of any one of embodiments 43-45, wherein lipophilicity of the lipophilic moiety, measured by log Kow, exceeds 0.

47. The dsRNA agent of any one of the preceding embodiments, wherein the hydrophobicity of the double-stranded RNAi agent, measured by the unbound fraction in a plasma protein binding assay of the double-stranded RNAi agent, exceeds 0.2.

48. The dsRNA agent of embodiment 47, wherein the plasma protein binding assay is an electrophoretic mobility shift assay using human serum albumin protein.

49. The dsRNA agent of any of the preceding embodiments, wherein the dsRNA agent comprises at least one modified nucleotide.

50. The dsRNA agent of embodiment 49, wherein no more than five of the sense strand nucleotides and not more than five of the nucleotides of the antisense strand are unmodified nucleotides.

51. The dsRNA agent of embodiment 50, wherein all of the nucleotides of the sense strand and all of the nucleotides of the antisense strand comprise a modification.

52. The dsRNA agent of any one of embodiments 49-51, wherein at least one of the modified nucleotides is selected from the group consisting of a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a glycol modified nucleotide, and a 2-O-(N-methylacetamide) modified nucleotide; and combinations thereof.

53. The dsRNA agent of any of embodiments 49-51, wherein no more than five of the sense strand nucleotides and not more than five of the nucleotides of the antisense strand include modifications other than 2'-O-methyl modified nucleotide, a 2'-fluoro modified nucleotide, a 2'-deoxy-modified nucleotide, unlocked nucleic acids (UNA) or glycerol nucleic acid (GNA).

54. The dsRNA agent of any of the preceding embodiments, which comprises a non-nucleotide spacer (wherein optionally the non-nucleotide spacer comprises a C3-C6 alkyl) between two of the contiguous nucleotides of the sense strand or between two of the contiguous nucleotides of the antisense strand.

55. The dsRNA agent of any of the preceding embodiments, wherein each strand is no more than 30 nucleotides in length.

56. The dsRNA agent of any of the preceding embodiments, wherein at least one strand comprises a 3' overhang of at least 1 nucleotide.

57. The dsRNA agent of any of the preceding embodiments, wherein at least one strand comprises a 3' overhang of at least 2 nucleotides.

58. The dsRNA agent of any of the preceding embodiments, wherein the double stranded region is 15-30 nucleotide pairs in length.

59. The dsRNA agent of embodiment 58, wherein the double stranded region is 17-23 nucleotide pairs in length.

60. The dsRNA agent of embodiment 58, wherein the double stranded region is 17-25 nucleotide pairs in length.

61. The dsRNA agent of embodiment 58, wherein the double stranded region is 23-27 nucleotide pairs in length.

62. The dsRNA agent of embodiment 58, wherein the double stranded region is 19-21 nucleotide pairs in length.

63. The dsRNA agent of embodiment 58, wherein the double stranded region is 21-23 nucleotide pairs in length.

64. The dsRNA agent of any of the preceding embodiments, wherein each strand has 19-30 nucleotides.

65. The dsRNA agent of any of the preceding embodiments, wherein each strand has 19-23 nucleotides.

66. The dsRNA agent of any of the preceding embodiments, wherein each strand has 21-23 nucleotides.

67. The dsRNA agent of any of the preceding embodiments, wherein the agent comprises at least one phosphorothioate or methylphosphonate internucleotide linkage.

68. The dsRNA agent of embodiment 67, wherein the phosphorothioate or methylphosphonate internucleotide linkage is at the 3'-terminus of one strand.

69. The dsRNA agent of embodiment 68, wherein the strand is the antisense strand.

70. The dsRNA agent of embodiment 68, wherein the strand is the sense strand.

71. The dsRNA agent of embodiment 67, wherein the phosphorothioate or methylphosphonate internucleotide linkage is at the 5'-terminus of one strand.

72. The dsRNA agent of embodiment 71, wherein the strand is the antisense strand.

73. The dsRNA agent of embodiment 71, wherein the strand is the sense strand.

74. The dsRNA agent of embodiment 67, wherein each of the 5'- and 3'-terminus of one strand comprises a phosphorothioate or methylphosphonate internucleotide linkage.

75. The dsRNA agent of embodiment 74, wherein the strand is the antisense strand.

76. The dsRNA agent of any of the preceding embodiments, wherein the base pair at the 1 position of the 5'-end of the antisense strand of the duplex is an AU base pair.

77. The dsRNA agent of embodiment 74, wherein the sense strand has a total of 21 nucleotides and the antisense strand has a total of 23 nucleotides.

78. The dsRNA agent of any one of embodiments 43-77, wherein one or more lipophilic moieties are conjugated to one or more internal positions on at least one strand.

79. The dsRNA agent of embodiment 78, wherein the one or more lipophilic moieties are conjugated to one or more internal positions on at least one strand via a linker or carrier.

80. The dsRNA agent of embodiment 79, wherein the internal positions include all positions except the terminal two positions from each end of the at least one strand.

81. The dsRNA agent of embodiment 79, wherein the internal positions include all positions except the terminal three positions from each end of the at least one strand.

82. The dsRNA agent of any one of embodiments 79-61, wherein the internal positions exclude a cleavage site region of the sense strand.

83. The dsRNA agent of embodiment 82, wherein the internal positions include all positions except positions 9-12, counting from the 5'-end of the sense strand.

84. The dsRNA agent of embodiment 82, wherein the internal positions include all positions except positions 11-13, counting from the 3'-end of the sense strand.

85. The dsRNA agent of any one of embodiments 79-81, wherein the internal positions exclude a cleavage site region of the antisense strand.

86. The dsRNA agent of embodiment 85, wherein the internal positions include all positions except positions 12-14, counting from the 5'-end of the antisense strand.

87. The dsRNA agent of any one of embodiments 79-81, wherein the internal positions include all positions except positions 11-13 on the sense strand, counting from the 3'-end, and positions 12-14 on the antisense strand, counting from the 5'-end.

88. The dsRNA agent of any one of embodiments 43-87, wherein the one or more lipophilic moieties are conjugated to one or more of the internal positions selected from the group consisting of positions 4-8 and 13-18 on the sense strand, and positions 6-10 and 15-18 on the antisense strand, counting from the 5'end of each strand.

89. The dsRNA agent of embodiment 88, wherein the one or more lipophilic moieties are conjugated to one or more of the internal positions selected from the group consisting of positions 5, 6, 7, 15, and 17 on the sense strand, and positions 15 and 17 on the antisense strand, counting from the 5'-end of each strand.

90. The dsRNA agent of embodiment 44, wherein the positions in the double stranded region exclude a cleavage site region of the sense strand.

91. The dsRNA agent of any one of embodiments 43-90, wherein the sense strand is 21 nucleotides in length, the antisense strand is 23 nucleotides in length, and the lipophilic moiety is conjugated to position 21, position 20, position 15, position 1, position 7, position 6, or position 2 of the sense strand or position 16 of the antisense strand.

92. The dsRNA agent of embodiment 91, wherein the lipophilic moiety is conjugated to position 21, position 20, position 15, position 1, or position 7 of the sense strand.

93. The dsRNA agent of embodiment 91, wherein the lipophilic moiety is conjugated to position 21, position 20, or position 15 of the sense strand.

94. The dsRNA agent of embodiment 91, wherein the lipophilic moiety is conjugated to position 20 or position 15 of the sense strand.

95. The dsRNA agent of embodiment 91, wherein the lipophilic moiety is conjugated to position 16 of the antisense strand.

96. The dsRNA agent of embodiment 91, wherein the lipophilic moiety is conjugated to position 6, counting from the 5'-end of the sense strand.

97. The dsRNA agent of any one of embodiments 43-96, wherein the lipophilic moiety is an aliphatic, alicyclic, or polyalicyclic compound.

98. The dsRNA agent of embodiment 98, wherein the lipophilic moiety is selected from the group consisting of lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine.

99. The dsRNA agent of embodiment 98, wherein the lipophilic moiety contains a saturated or unsaturated C4-C30 hydrocarbon chain, and an optional functional group selected from the group consisting of hydroxyl, amine, carboxylic acid, sulfonate, phosphate, thiol, azide, and alkyne.

100. The dsRNA agent of embodiment 99, wherein the lipophilic moiety contains a saturated or unsaturated C6-C18 hydrocarbon chain.

101. The dsRNA agent of embodiment 99, wherein the lipophilic moiety contains a saturated or unsaturated C16 hydrocarbon chain.

102. The dsRNA agent of any one of embodiments 43-101, wherein the lipophilic moiety is conjugated via a carrier that replaces one or more nucleotide(s) in the internal position(s) or the double stranded region.

103. The dsRNA agent of embodiment 102, wherein the carrier is a cyclic group selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl; or is an acyclic moiety based on a serinol backbone or a diethanolamine backbone.

104. The dsRNA agent of any one of embodiments 43-101, wherein the lipophilic moiety is conjugated to the double-stranded iRNA agent via a linker containing an ether, thioether, urea, carbonate, amine, amide, maleimide-thioether, disulfide, phosphodiester, sulfonamide linkage, a product of a click reaction, or carbamate.

105. The double-stranded iRNA agent of any one of embodiments 43-104, wherein the lipophilic moiety is conjugated to a nucleobase, sugar moiety, or internucleosidic linkage.

106. The dsRNA agent of any one of embodiments 43-105, wherein the lipophilic moiety is conjugated via a bio-cleavable linker selected from the group consisting of DNA, RNA, disulfide, amide, functionalized monosaccharides or oligosaccharides of galactosamine, glucosamine, glucose, galactose, mannose, and combinations thereof.

107. The dsRNA agent of any one of embodiments 43-106, wherein the 3' end of the sense strand is protected via an end cap which is a cyclic group having an amine, said cyclic group being selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl.

108. The dsRNA agent of any one of embodiments 43-107, further comprising a targeting ligand, e.g., a ligand that targets an ocular tissue or a liver tissue.

109. The dsRNA agent of embodiment 108, wherein the ligand is conjugated to the sense strand.

110. The dsRNA agent of embodiment 108 or 109, wherein the ligand is conjugated to the 3' end or the 5' end of the sense strand.

111. The dsRNA agent of embodiment 108 or 109, wherein the ligand is conjugated to the 3' end of the sense strand.

112. The dsRNA agent of any one of embodiments 108-111, wherein the ocular tissue is a retinal pigment epithelium (RPE) or choroid tissue, e.g., a choroid vessel.

113. The dsRNA agent of any one of embodiments 108-111, wherein the targeting ligand comprises N-acetyl-galactosamine (GalNAc).

114. The dsRNA agent of any one of embodiments 108-111, wherein the targeting ligand is one or more GalNAc conjugates or one or more or GalNAc derivatives.

115. The dsRNA agent of embodiment 114, wherein the one or more GalNAc conjugates or one or more GalNAc derivatives are attached through a monovalent linker, or a bivalent, trivalent, or tetravalent branched linker.

116. The dsRNA agent of embodiment 114, wherein the ligand is

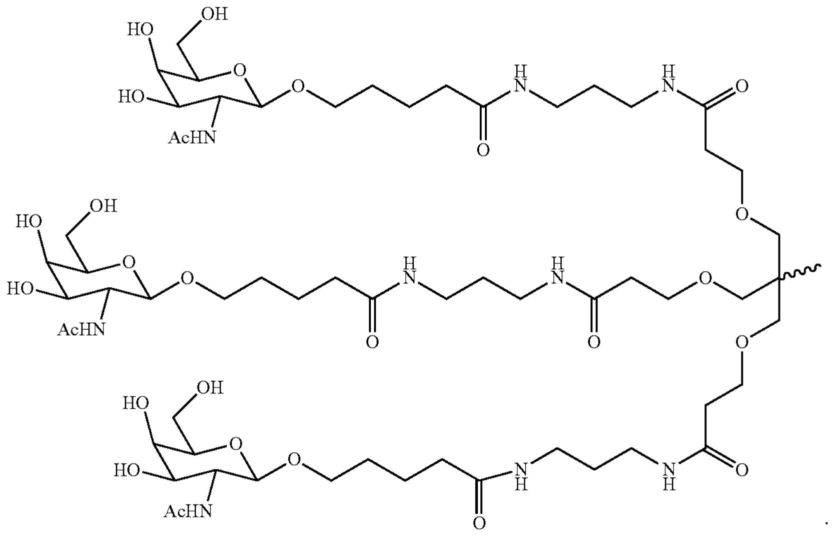 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

117. The dsRNA agent of embodiment 116, wherein the dsRNA agent is conjugated to the ligand as shown in the following schematic

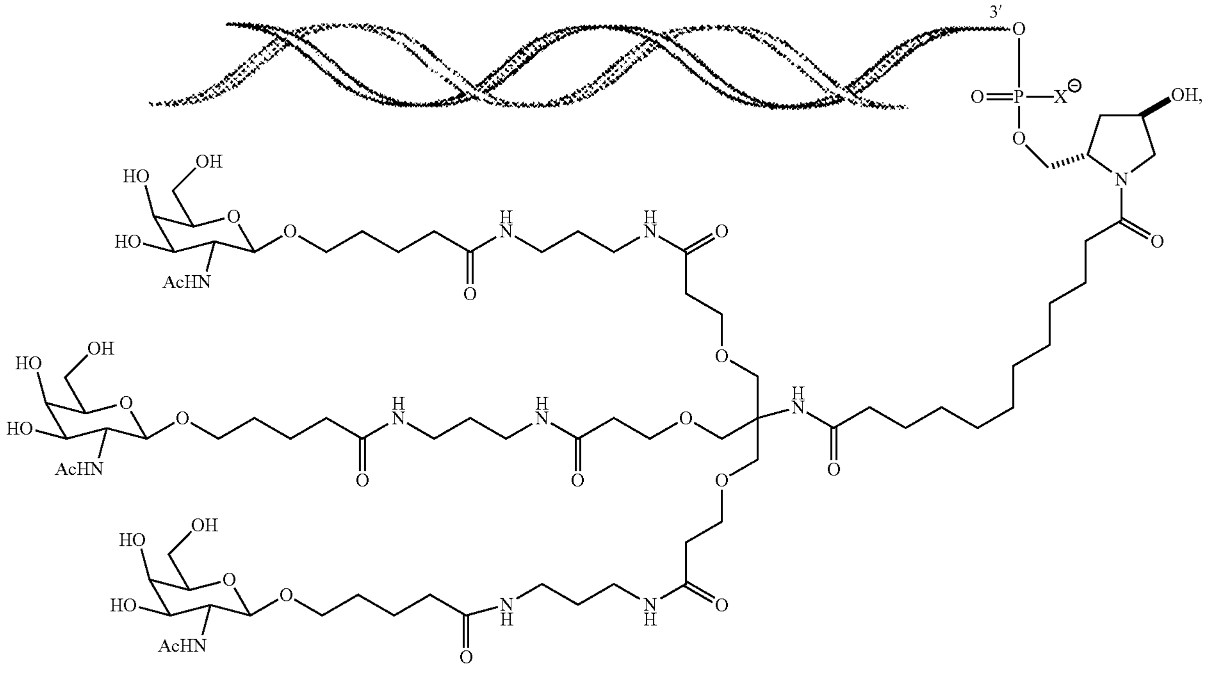

wherein X is O or S.

118. The dsRNA agent of embodiment 117, wherein the X is O.

119. The dsRNA agent of any one of embodiments 1-118, further comprising a terminal, chiral modification occurring at the first internucleotide linkage at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp configuration or Sp configuration.

120. The dsRNA agent of any one of embodiments 1-118, further comprising a terminal, chiral modification occurring at the first and second internucleotide linkages at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

121. The dsRNA agent of any one of embodiments 1-118, further comprising a terminal, chiral modification occurring at the first, second and third internucleotide linkages at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

122. The dsRNA agent of any one of embodiments 1-118, further comprising a terminal, chiral modification occurring at the first, and second internucleotide linkages at the 3' end of the antisense strand, having the linkage phosphorus atom in Sp configuration, a terminal, chiral modification occurring at the third internucleotide linkages at the 3' end of the antisense strand, having the linkage phosphorus atom in Rp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

123. The dsRNA agent of any one of embodiments 1-118, further comprising a terminal, chiral modification occurring at the first, and second internucleotide linkages at the 3' end of the antisense strand, having the linkage phosphorus atom in Sp configuration, a terminal, chiral modification occurring at the first, and second internucleotide linkages at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

124. The dsRNA agent of any one of embodiments 1-123, further comprising a phosphate or phosphate mimic at the 5'-end of the antisense strand.

125. The dsRNA agent of embodiment 104, wherein the phosphate mimic is a 5'-vinyl phosphonate (VP).

126. A cell containing the dsRNA agent of any one of embodiments 1-125.

127. A human ocular cell, e.g., (an RPE cell, an astrocyte, a pericyte, a Müller cell, a ganglion cell, an endothelial cell, or a photoreceptor cell) comprising a reduced level of VEGF-A mRNA or a level of VEGF-A protein as compared to an otherwise similar untreated cell, wherein optionally the level is reduced by at least 10%, 15%, 20%, 25%, 30%, 35%, 40%, 45%, 50%, 55%, 60%, 65%, 70%, 75%, 80%, 85%, 90%, or 95%.

128. The human cell of embodiment 127, which was produced by a process comprising contacting a human cell with the dsRNA agent of any one of embodiments 1-125.

129. A pharmaceutical composition for inhibiting expression of VEGF-A, comprising the dsRNA agent of any one of embodiments 1-125.

130. A pharmaceutical composition comprising the dsRNA agent of any one of embodiments 1-125 and a lipid formulation.

131. A method of inhibiting expression of VEGF-A in a cell, the method comprising:

(a) contacting the cell with the dsRNA agent of any one of embodiments 1-125, or a pharmaceutical composition of embodiment 129 or 130; and (b) maintaining the cell produced in step (a) for a time sufficient to obtain degradation of the mRNA transcript of VEGF-A, thereby inhibiting expression of VEGF-A in the cell.

132. A method of inhibiting expression of VEGF-A in a cell, the method comprising:

(a) contacting the cell with the dsRNA agent of any one of embodiments 1-125, or a pharmaceutical composition of embodiment 129 or 130; and (b) maintaining the cell produced in step (a) for a time sufficient to reduce levels of VEGF-A mRNA, VEGF-A protein, or both of VEGF-A mRNA and protein, thereby inhibiting expression of VEGF-A in the cell.

133. The method of embodiment 131 or 132, wherein the cell is within a subject.

134. The method of embodiment 133, wherein the subject is a human.

135. The method of any one of embodiments 131-134, wherein the level of VEGF-A mRNA is inhibited by at least 50%.

136. The method of any one of embodiments 131-134, wherein the level of VEGF-A protein is inhibited by at least 50%.

137. The method of embodiment 134-136, wherein inhibiting expression of VEGF-A decreases a VEGF-A protein level in a biological sample (e.g., an aqueous ocular fluid sample) from the subject by at least 30%, 40%, 50%, 60%, 70%, 80%, 90%, or 95%.

138. The method of any one of embodiments 134-137, wherein the subject has been diagnosed with a VEGF-A-associated disorder, e.g., wet age-related macular degeneration (wet AMD), diabetic retinopathy (DR), diabetic macular edema (DME), retinal vein occlusion (RVO), macular edema following retinal vein occlusion (MEfRVO), retinopathy of prematurity (ROP), or myopic choroidal neovascularization (mCNV).

139. A method of inhibiting expression of VEGF-A in an ocular cell or tissue, the method comprising:

(a) contacting the cell or tissue with a dsRNA agent that binds VEGF-A; and (b) maintaining the cell or tissue produced in step (a) for a time sufficient to reduce levels of VEGF-A mRNA, VEGF-A protein, or both of VEGF-A mRNA and protein, thereby inhibiting expression of VEGF-A in the cell or tissue.

140. The method of embodiment 139, wherein the ocular cell or tissue comprises an RPE cell, a retinal tissue, an astrocyte, a pericyte, a Müller cell, a ganglion cell, an endothelial cell, a photoreceptor cell, a retinal blood vessel (e.g., including endothelial cells and vascular smooth muscle cells), or choroid tissue, e.g., a choroid vessel.

141. A method of treating a subject diagnosed with a VEGF-A-associated disorder comprising administering to the subject a therapeutically effective amount of the dsRNA agent of any one of embodiments 1-125 or a pharmaceutical composition of embodiment 129 or 130, thereby treating the disorder.

142. The method of embodiment 138 or 141, wherein the VEGF-A-associated disorder is an angiogenic ocular disorder.

143. The method of embodiment 142, wherein the angiogenic ocular disorder is selected from the group consisting of AMD, DR, DME, RVO, CVO, MEfRVO, ROP, or mCNV.

144. The method of any one of embodiments 141-143, wherein treating comprises amelioration of at least one sign or symptom of the disorder.

145. The method of embodiment 144, wherein at least one sign or symptom of the angiogenic ocular disorder comprises a measure of one or more of angiogenesis, choroidal neovascularization, ocular inflammation, visual acuity, or presence, level, or activity of VEGF-A (e.g., VEGF-A gene, VEGF-A mRNA, or VEGF-A protein).

146. The method of any one of embodiments 141-143, where treating comprises prevention of progression of the disorder.

147. The method of any one of embodiments 144-146, wherein the treating comprises one or more of (a) inhibiting angiogenesis; (b) inhibiting or reducing the expression or activity of VEGF-A; (c) inhibiting choroidal neovascularization; (d) inhibiting growth of new blood vessels in the choriocapillaris; (e) reducing retinal thickness; (f) increasing visual acuity; or (g) reducing intraocular inflammation.

148. The method of embodiment 147, wherein the treating results in at least a 30% mean reduction from baseline of VEGF mRNA in the retina, RPE, a retinal blood vessel (e.g., including endothelial cells and vascular smooth muscle cells), or choroid tissue, e.g., a choroid vessel.

149. The method of embodiment 148 wherein the treating results in at least a 60% mean reduction from baseline of VEGF mRNA in the retina, RPE, a retinal blood vessel (e.g., including endothelial cells and vascular smooth muscle cells), or choroid tissue, e.g., a choroid vessel.

150. The method of embodiment 149, wherein the treating results in at least a 90% mean reduction from baseline of VEGF mRNA in the retina, RPE, a retinal blood vessel (e.g., including endothelial cells and vascular smooth muscle cells), or choroid tissue, e.g., a choroid vessel.

151. The method of any one of embodiments 144-149, wherein after treatment the subject experiences at least an 8-week duration of knockdown following a single dose of dsRNA as assessed by VEGF-A protein in the retina.

152. The method of embodiment 151, wherein treating results in at least a 12-week duration of knockdown following a single dose of dsRNA as assessed by VEGF-A protein in the retina.

153. The method of embodiment 152, wherein treating results in at least a 16-week duration of knockdown following a single dose of dsRNA as assessed by VEGF-A protein in the retina.

154. The method of any of embodiments 133-153, wherein the subject is human.

155. The method of any one of embodiments 134-154, wherein the dsRNA agent is administered at a dose of about 0.01 mg/kg to about 50 mg/kg.

156. The method of any one of embodiments 134-155, wherein the dsRNA agent is administered to the subject intraocularly, intravenously, or topically.

157. The method of embodiment 156, wherein the intraocular administration comprises intravitreal administration (e.g., intravitreal injection), transscleral administration (e.g., transscleral injection), subconjunctival administration (e.g., subconjunctival injection), retrobulbar administration (e.g., retrobulbar injection), intracameral administration (e.g., intracameral injection), or subretinal administration (e.g., subretinal injection).

158. The method of any one of embodiments 134-157, further comprising measuring level of VEGF-A (e.g., VEGF-A gene, VEGF-A mRNA, or VEGF-A protein) in the subject.

159. The method of embodiment 158, where measuring the level of VEGF-A in the subject comprises measuring the level of VEGF-A gene, VEGF-A protein or VEGF-A mRNA in a biological sample from the subject (e.g., an aqueous ocular fluid sample).

160. The method of any one of embodiments 134-159, further comprising performing a blood test, an imaging test, or an aqueous ocular fluid biopsy.

161. The method of any one of embodiments 158-168, wherein measuring level of VEGF-A (e.g., VEGF-A gene, VEGF-A mRNA, or VEGF-A protein) in the subject is performed prior to treatment with the dsRNA agent or the pharmaceutical composition.

162. The method of embodiment 161, wherein, upon determination that a subject has a level of VEGF-A (e.g., VEGF-A gene, VEGF-A mRNA, or VEGF-A protein) that is greater than a reference level, the dsRNA agent or the pharmaceutical composition is administered to the subject.

163. The method of any one of embodiments 159-162, wherein measuring level of VEGF-A (e.g., VEGF-A gene, VEGF-A mRNA, or VEGF-A protein) in the subject is performed after treatment with the dsRNA agent or the pharmaceutical composition.

164. The method of any one of embodiments 141-163, further comprising administering to the subject an additional agent and/or therapy suitable for treatment or prevention of an VEGF-A-associated disorder.

165. The method of embodiment 164, wherein the additional agent and/or therapy comprises one or more of a photodynamic therapy, photocoagulation therapy, a steroid, a non-steroidal anti-inflammatory agent, an anti-VEGF-A agent, and/or a vitrectomy.

166. The method of embodiment 165, wherein the anti-VEGF-A agent is a fusion protein or an anti-VEGF-A antibody or antigen-binding fragment thereof (e.g., an anti-VEGF-A antibody molecule).

EXAMPLES

Example 1. VEGF-A siRNA

Nucleic acid sequences provided herein are represented using standard nomenclature. See the abbreviations of Table 1.

TABLE 1

Abbreviations of nucleotide monomers used in nucleic acid sequence representation
It will be understood that these monomers, when present in an oligonucleotide, are mutually linked by 5'-3'-phosphodiester bonds.

| Abbreviation | Nucleotide(s) |
|---|---|
| A | Adenosine-3'-phosphate |
| Ab | beta-L-adenosine-3'-phosphate |
| Abs | beta-L-adenosine-3'-phosphorothioate |
| Af | 2'-fluoroadenosine-3'-phosphate |
| Afs | 2'-fluoroadenosine-3'-phosphorothioate |
| (Ahd) | 2'-O-hexadecyl-adenosine-3'-phosphate |
| (Ahds) | 2'-O-hexadecyl-adenosine-3'-phosphorothioate |
| As | adenosine-3'-phosphorothioate |
| (A2p) | adenosine 2'-phosphate |
| C | cytidine-3'-phosphate |
| Cb | beta-L-cytidine-3'-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| (Chd) | 2'-O-hexadecyl-cytidine-3'-phosphate |
| (Chds) | 2'-O-hexadecyl-cytidine-3'-phosphorothioate |
| Cs | cytidine-3'-phosphorothioate |
| (C2p) | cytosine 2'-phosphate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| (Ghd) | 2'-O-hexadecyl-guanosine-3'-phosphate |
| (Ghds) | 2'-O-hexadecyl-guanosine-3'-phosphorothioate |
| Gs | guanosine-3'-phosphorothioate |
| T | 5'-methyluridine-3'-phosphate |
| Tb | beta-L-thymidine-3'-phosphate |
| Tbs | beta-L-thymidine-3'-phosphorothioate |
| Tf | 2'-fluoro-5-methyluridine-3'-phosphate |
| Tfs | 2'-fluoro-5-methyluridine-3'-phosphorothioate |
| Tgn | thymidine-glycol nucleic acid (GNA) S-Isomer |
| Agn | adenosine-glycol nucleic acid (GNA) S-Isomer |
| Cgn | cytidine-glycol nucleic acid (GNA) S-Isomer |
| Ggn | guanosine-glycol nucleic acid (GNA) S-Isomer |
| Ts | 5-methyluridine-3'-phosphorothioate |
| U | Uridine-3'-phosphate |
| Ub | beta-L-uridine-3'-phosphate |
| Ubs | beta-L-uridine-3'-phosphorothioate |
| Uf | 2'-fluorouridine-3'-phosphate |
| Ufs | 2'-fluorouridine-3'-phosphorothioate |
| (Uhd) | 2'-O-hexadecyl-uridine-3'-phosphate |
| (Uhds) | 2'-O-hexadecyl-uridine-3'-phosphorothioate |
| Us | uridine-3'-phosphorothioate |
| (U2p) | uracil 2'-phosphate |
| N | any nucleotide (G, A, C, T or U) |
| VP | Vinyl phosphonate |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| dA | 2'-deoxyadenosine-3'-phosphate |
| dAs | 2'-deoxyadenosine-3'-phosphorothioate |
| dC | 2'-deoxycytidine-3'-phosphate |

TABLE 1-continued

Abbreviations of nucleotide monomers used in nucleic acid sequence representation
It will be understood that these monomers, when present in an oligonucleotide, are mutually linked by 5'-3'-phosphodiester bonds.

| Abbreviation | Nucleotide(s) |
|---|---|
| dCs | 2'-deoxycytidine-3'-phosphorothioate |
| dG | 2'-deoxyguanosine-3'-phosphate |
| dGs | 2'-deoxyguanosine-3'-phosphorothioate |
| dT | 2'-deoxythymidine |
| dTs | 2'-deoxythymidine-3'-phosphorothioate |
| dU | 2'-deoxyuridine |
| s | phosphorothioate linkage |
| L96[1] | N-[tris(GalNAc-alkyl)-amidodecanoyl)]-4-hydroxyprolinol Hyp-(GalNAc-alkyl)3 |
| (Aeo) | 2'-O-methoxyethyladenosine-3'-phosphate |
| (Aeos) | 2'-O-methoxyethyladenosine-3'-phosphorothioate |
| (Geo) | 2'-O-methoxyethylguanosine-3'-phosphate |
| (Geos) | 2'-O-methoxyethylguanosine-3'-phosphorothioate |
| (Teo) | 2'-O-methoxyethyl-5-methyluridine-3'-phosphate |
| (Teos) | 2'-O-methoxyethyl-5-methyluridine-3'-phosphorothioate |
| (m5Ceo) | 2'-O-methoxyethyl-5-methylcytidine-3'-phosphate |
| (m5Ceos) | 2'-O-methoxyethyl-5-methylcytidine-3'-phosphorothioate |

[1]The chemical structure of L96 is as follows:

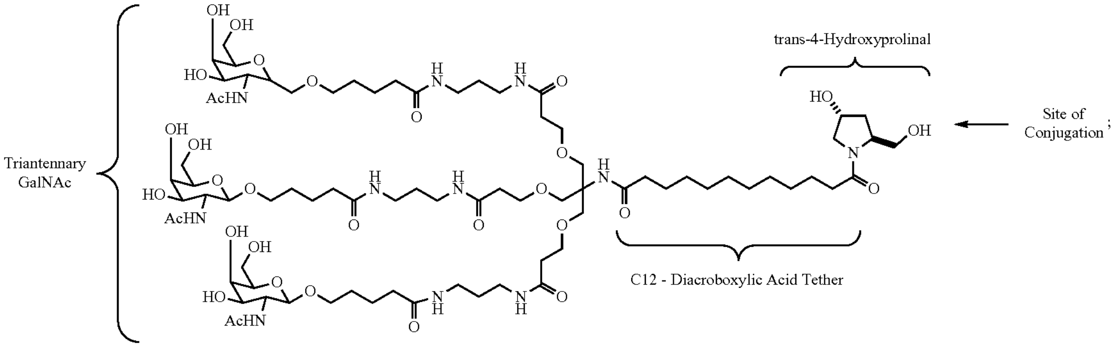

Experimental Methods

Bioinformatics

Transcripts

Three sets of siRNAs targeting the human VEGF-A, "vascular endothelial growth factor A" (human: NCBI refseqID NM_001171623; NCBI GeneID: 7422) were generated. The human NM_001171623 REFSEQ mRNA, version 1, has a length of 3677 bases. Pairs of oligos were generated using bioinformatic methods and ranked, and exemplary pairs of oligos are shown in Table 2A, Table 2B, Table 3A, Table 3B, Table 4A, Table 4B, Table 8A, Table 8B, Table 10A, Table 10B, Table 18A, and Table 18B. Modified sequences are presented in Table 2A, Table 3A, Table 4A, Table 8A, Table 10A, Table 18A. Unmodified sequences are presented in Table 2B, Table 3B, Table 4B, Table 8B, Table 10B, Table 18B.

Similarly, a set of siRNAs targeting rat VEGF-A (rat: NCBI refseqID NM_001110333; NCBI GeneID 83785 were generated. The rat NM_001110333.2REFSEQ mRNA, version 2, has a length of 3474 base pairs. Pairs of oligos were generated using bioinformatic methods and ranked, and exemplary pairs of oligos are shown in Table 5A and Table 5B. Modified sequences are presented in Table 5A. Unmodified sequences are presented in Table 5B.

TABLE 2A

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA target sequence | SEQ ID NO: (mRNA target) |
|---|---|---|---|---|---|---|---|---|
| AD-901349.1 | A-1701255.1 | 4156 | asasgac(Uhd)GfaUfAfCfagaacgaucaL96 | A-1701256.1 | 130 | VPusGfsaucg(Tgn)ucuguaUfcAfgucuususc | GAAAGACUGAUACAGAACGAUCG | 4224 |
| AD-901376.1 | A-1701309.1 | 4157 | ascsggu(Ahd)CfuUfAfUfuuaauauccaL96 | A-1701310.1 | 131 | VPusGfsgaua(Tgn)uaaauaAfgUfaccgusasu | AUACGGUACUUAUUUAAUAUCCC | 4225 |

TABLE 2A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA target sequence | SEQ ID NO: (mRNA target) |
|---|---|---|---|---|---|---|---|---|
| AD-901356.1 | A-1701269.1 | 3 | csasgaa(Chd)AfgUfCfCfuuaauccagaL96 | A-1701270.1 | 132 | VPusCfsugga(Tgn)uaaggaCfuGfuucugsusc | GACAGAACAGUCCUUAAUCCAGA | 4226 |
| AD-901355.1 | A-1701267.1 | 4 | csgsaca(Ghd)AfaCfAfGfuccuuaaucaL96 | A-1701268.1 | 133 | VPusGfsauua(Agn)ggacugUfuCfugucgsasu | AUCGACAGAACAGUCCUUAAUCC | 4227 |
| AD-901407.1 | A-1701371.1 | 5 | gscsauu(Uhd)GfuUfUfGfuacaagaucaL96 | A-1701372.1 | 134 | VPusGfsaucu(Tgn)guacaaAfcAfaaugcsusu | AAGCAUUUGUUUGUACAAGAUCC | 4228 |
| AD-901367.1 | A-1701291.1 | 6 | usasuug(Ghd)UfgUfCfUfucacuggauaL96 | A-1701292.1 | 135 | VPusAfsucca(Ggn)ugaagaCfaCfcaauasasc | GUUAUUGGUGUCUUCACUGGAUG | 4229 |
| AD-901352.1 | A-1701261.1 | 7 | ascsuga(Uhd)AfcAfGfAfacgaucgauaL96 | A-1701262.1 | 136 | VPusAfsucga(Tgn)cguucuGfuAfucaguscsu | AGACUGAUACAGAACGAUCGAUA | 4230 |
| AD-901348.1 | A-1701253.1 | 8 | asasaga(Chd)UfgAfUfAfcagaacgauaL96 | A-1701254.1 | 137 | VPusAfsucgu(Tgn)cuguauCfaGfucuuuscsc | GGAAAGACUGAUACAGAACGAUC | 4231 |
| AD-901354.1 | A-1701265.1 | 9 | asusaca(Ghd)AfaCfGfAfucgauacagaL96 | A-1701266.1 | 138 | VPusCfsugua(Tgn)cgaucgUfuCfuguauscsa | UGAUACAGAACGAUCGAUACAGA | 4232 |
| AD-901353.1 | A-1701263.1 | 10 | csusgau(Ahd)CfaGfAfAfcgaucgauaaL96 | A-1701264.1 | 139 | VPusUfsaucg(Agn)ucguucUfgUfaucagsusc | GACUGAUACAGAACGAUCGAUAC | 4233 |
| AD-901375.1 | A-1701307.1 | 11 | gsasgaa(Ahd)GfuGfUfUfuuauauacgaL96 | A-1701308.1 | 140 | VPusCfsguau(Agn)uaaaacAfcUfuucucsusu | AAGAGAAAGUGUUUUAUAUACGG | 4234 |
| AD-901345.1 | A-1701247.1 | 12 | ascsgaa(Chd)GfuAfCfUfugcagauguaL96 | A-1701248.1 | 141 | VPusAfscauc(Tgn)gcaaguAfcGfuucgususu | AAACGAACGUACUUGCAGAUGUG | 4235 |
| AD-901357.1 | A-1701271.1 | 13 | csusugg(Ahd)AfuUfGfGfauucgccauaL96 | A-1701272.1 | 142 | VPusAfsuggc(Ggn)aauccaAfuUfccaagsasg | CUCUUGGAAUUGGAUUCGCCAUU | 4236 |
| AD-901334.1 | A-1701225.1 | 14 | gsgscag(Chd)UfuGfAfGfuuaaacgaaaL96 | A-1701226.1 | 143 | VPusUfsucgu(Tgn)uaacucAfaGfcugccsusc | GAGGCAGCUUGAGUUAAACGAAC | 4237 |
| AD-901313.1 | A-1701183.1 | 15 | gsgsgca(Ghd)AfaUfCfAfucacgaaguaL96 | A-1701184.1 | 144 | VPusAfscuuc(Ggn)ugaugaUfuCfugcccsusc | GAGGGCAGAAUCAUCACGAAGUG | 4238 |
| AD-901344.1 | A-1701245.1 | 16 | ususaaa(Chd)GfaAfCfGfuacuugcagaL96 | A-1701246.1 | 145 | VPusCfsugca(Agn)guacguUfcGfuuuaascsu | AGUUAAACGAACGUACUUGCAGA | 4239 |
| AD-901366.1 | A-1701289.1 | 17 | gsusuau(Uhd)GfgUfGfUfcuucacuggaL96 | A-1701290.1 | 146 | VPusCfscagu(Ggn)aagacaCfcAfauaacsasu | AUGUUAUUGGUGUCUUCACUGGA | 4240 |
| AD-901337.1 | A-1701231.1 | 18 | asgscuu(Ghd)AfgUfUfAfaacgaacguaL96 | A-1701232.1 | 147 | VPusAfscguu(Cgn)guuuaaCfuCfaagcusgsc | GCAGCUUGAGUUAAACGAACGUA | 4241 |
| AD-901335.1 | A-1701227.1 | 19 | gscsagc(Uhd)UfgAfGfUfuaaacgaacaL96 | A-1701228.1 | 148 | VPusGfsuucg(Tgn)uuaacuCfaAfgcugcscsu | AGGCAGCUUGAGUUAAACGAACG | 4242 |
| AD-901398.1 | A-1701353.1 | 20 | csgsaag(Uhd)GfgUfGfAfaguucauggaL96 | A-1701354.1 | 149 | VPusCfscaug(Agn)acuucaCfcAfcuucgsusg | CACGAAGUGGUGAAGUUCAUGGA | 4243 |

TABLE 2A-continued

| Exemplary Human VEGF-A siRNA Modified Single Strands and Duplex Sequences | | | | | | | | |
|---|---|---|---|---|---|---|---|---|
| Duplex Name | Sense Oligo Name | SEQ ID NO: (Sense) | Sense Sequence | Anti-sense Oligo Name | SEQ ID NO: (Anti-sense) | Antisense Sequence | mRNA target sequence | SEQ ID NO: (mRNA target) |
| AD-901314.1 | A-1701185.1 | 21 | csasgaa(Uhd)CfaUfCfAfcgaaguggguaL96 | A-1701186.1 | 150 | VPusAfsccac(Tgn)ucgugaUfgAfuucugscsc | GGCAGAAUCAUCACGAAGUGGUG | 4244 |
| AD-901386.1 | A-1701329.1 | 22 | asasaau(Ahd)GfaCfAfUfugcuauucuaL96 | A-1701330.1 | 151 | VPusAfsgaau(Agn)gcaaugUfcUfauuuusasu | AUAAAAUAGACAUUGCUAUUCUG | 4245 |
| AD-901336.1 | A-1701229.1 | 23 | csasgcu(Uhd)GfaGfUfUfaaacgaacgaL96 | A-1701230.1 | 152 | VPusCfsguuc(Ggn)uuuaacUfcAfagcugscsc | GGCAGCUUGAGUUAAACGAACGU | 4246 |
| AD-901310.1 | A-1701177.1 | 24 | csgscac(Uhd)GfaAfAfCfuuuucguccaL96 | A-1701178.1 | 153 | VPusGfsgacg(Agn)aaaguuUfcAfgugcgsasc | GUCGCACUGAAACUUUUCGUCCA | 4247 |
| AD-901321.1 | A-1701199.1 | 25 | asgsauu(Ahd)UfgCfGfGfaucaaaccuaL96 | A-1701200.1 | 154 | VPusAfsgguu(Tgn)gauccgCfaUfaaucusgsc | GCAGAUUAUGCGGAUCAAACCUC | 4248 |
| AD-901382.1 | A-1701321.1 | 26 | gscsucu(Chd)UfuAfUfUfuguaccgguaL96 | A-1701322.1 | 155 | VPusAfsccgg(Tgn)acaaauAfaGfagagcsasa | UUGCUCUCUUAUUUGUACCGGUU | 4249 |
| AD-901384.1 | A-1701325.1 | 27 | usgsaca(Ghd)UfcAfCfUfagcuuaucuaL96 | A-1701326.1 | 156 | VPusAfsgaua(Agn)gcuaguGfaCfugucascsc | GGUGACAGUCACUAGCUUAUCUU | 4250 |
| AD-901339.1 | A-1701235.1 | 28 | csusuga(Ghd)UfuAfAfAfcgaacguacaL96 | A-1701236.1 | 157 | VPusGfsuacg(Tgn)ucguuuAfaCfucaagscsu | AGCUUGAGUUAAACGAACGUACU | 4251 |
| AD-901363.1 | A-1701283.1 | 29 | asgsugc(Uhd)AfaUfGfUfuauugguguaL96 | A-1701284.1 | 158 | VPusAfscacc(Agn)auaacaUfuAfgcacusgsu | ACAGUGCUAAUGUUAUUGGUGUC | 4252 |
| AD-901325.1 | A-1701207.1 | 30 | asusccg(Chd)AfgAfCfGfuguaaauguaL96 | A-1701208.1 | 159 | VPusAfscauu(Tgn)acacguCfuGfcggauscsu | AGAUCCGCAGACGUGUAAAUGUU | 4253 |
| AD-901350.1 | A-1701257.1 | 31 | asgsacu(Ghd)AfuAfCfAfgaacgaucgaL96 | A-1701258.1 | 160 | VPusCfsgauc(Ggn)uucuguAfuCfagucusvsu | AAAGACUGAUACAGAACGAUCGA | 4254 |
| AD-901365.1 | A-1701287.1 | 32 | usgsuua(Uhd)UfgGfUfGfucuucacugaL96 | A-1701288.1 | 161 | VPusCfsagug(Agn)agacacCfaAfuaacasusu | AAUGUUAUUGGUGUCUUCACUGG | 4255 |
| AD-901306.1 | A-1701169.1 | 33 | gsusgcu(Ghd)GfaAfUfUfugauauucaaL96 | A-1701170.1 | 162 | VPusUfsgaau(Agn)ucaaauUfcCfagcacscsg | CGGUGCUGGAAUUUGAUAUUCAU | 4256 |
| AD-901361.1 | A-1701279.1 | 34 | usgsgcu(Ghd)CfuAfAfAfucaccgagcaL96 | A-1701280.1 | 163 | VPusGfscucg(Ggn)ugauuuAfgCfagcaasgsa | UCUUGCUGCUAAAUCACCGAGCC | 4257 |
| AD-901320.1 | A-1701197.1 | 35 | csascca(Uhd)GfcAfGfAfuuaugcggaaL96 | A-1701198.1 | 164 | VPusUfsccgc(Agn)uaaucuGfcAfuggugsasu | AUCACCAUGCAGAUUAUGCGGAU | 4258 |
| AD-901405.1 | A-1701367.1 | 36 | gsasaag(Chd)AfuUfUfGfuuuguacaaaL96 | A-1701368.1 | 165 | VPusUfsugua(Cgn)aaacaaAfuGfcuuucsusc | GAGAAAGCAUUUGUUUGUACAAG | 4259 |
| AD-901338.1 | A-1701233.1 | 37 | gscsuug(Ahd)GfuUfAfAfacgaacguaaL96 | A-1701234.1 | 166 | VPusUfsacgu(Tgn)cguuuaAfcUfcaagcsusg | CAGCUUGAGUUAAACGAACGUAC | 4260 |
| AD-901383.1 | A-1701323.1 | 38 | uscsggu(Ghd)AfcAfGfUfcacuagcuuaL96 | A-1701324.1 | 167 | VPusAfsagcu(Agn)gugacuGfuCfaccgasusc | GAUCGGUGACAGUCACUAGCUUA | 4261 |

TABLE 2A-continued

| Duplex Name | Sense Oligo Name | SEQ ID NO: (Sense) | Sense Sequence | Anti-sense Oligo Name | SEQ ID NO: (Anti-sense) | Antisense Sequence | mRNA target sequence | SEQ ID NO: (mRNA target) |
|---|---|---|---|---|---|---|---|---|
| Exemplary Human VEGF-A siRNA Modified Single Strands and Duplex Sequences | | | | | | | | |
| AD-901333.1 | A-1701223.1 | 39 | asgsgca(Ghd)CfuUfGfAfguuaaacgaaL96 | A-1701224.1 | 168 | VPusUfscguu(Tgn)aacucaAfgCfugccuscsg | CGAGGCAGCUUGAGUUAAACGAA | 4262 |
| AD-901330.1 | A-1701217.1 | 40 | csusgca(Ahd)AfaAfCfAfcagacucgcaL96 | A-1701218.1 | 169 | VPusGfscgag(Tgn)cuguguUfuUfugcagsgsa | UCCUGCAAAAACACAGACUCGCG | 4263 |
| AD-901360.1 | A-1701277.1 | 41 | csusugc(Uhd)GfcUfAfAfaucaccgagaL96 | A-1701278.1 | 170 | VPusCfsucgg(Tgn)gauuuaGfcAfgcaagsasa | UUCUUGCUGCUAAAUCACCGAGC | 4264 |
| AD-901358.1 | A-1701273.1 | 42 | usu

cuu(Ghd)CfuGfCfUfaaaucaccgaL96 | A-1701274.1 | 171 | VPusCfsggug(Agn)uuuagcAfgCfaagaasasa | UUUUCUUGCUGCUAAAUCACCGA | 4265 |
| AD-901406.1 | A-1701369.1 | 43 | asasagc(Ahd)UfuUfGfUfuuguacaagaL96 | A-1701370.1 | 172 | VPusCfsuugu(Agn)caaacaAfaUfgcuuuscsu | AGAAAGCAUUUGUUUGUACAAGA | 4266 |
| AD-901326.1 | A-1701209.1 | 44 | uscscgc(Ahd)GfaCfGfUfguaaauguuaL96 | A-1701210.1 | 173 | VPusAfsacau(Tgn)uacacgUfcUfgcggasusc | GAUCCGCAGACGUGUAAAUGUUC | 4267 |
| AD-901377.1 | A-1701311.1 | 45 | csgsgua(Chd)UfuAfUfUfuaauaucccaL96 | A-1701312.1 | 174 | VPusGfsggau(Agn)uuaaauAfaGfuaccgsusa | UACGGUACUUAUUUAAUAUCCCU | 4268 |
| AD-901351.1 | A-1701259.1 | 46 | gsascug(Ahd)UfaCfAfGfaacgaucgaaL96 | A-1701260.1 | 175 | VPusUfscgau(Cgn)guucugUfaUfcagucsusu | AAGACUGAUACAGAACGAUCGAU | 4269 |
| AD-901415.1 | A-1701387.1 | 47 | asasaac(Ahd)CfaGfAfCfucgcguugcaL96 | A-1701388.1 | 176 | VPusGfscaac(Ggn)cgagucUfgUfguuuusus

g | CAAAAACACAGACUCGCGUUGCA | 4270 |
| AD-901342.1 | A-1701241.1 | 48 | gsasguu(Ahd)AfaCfGfAfacguacuugaL96 | A-1701242.1 | 177 | VPusCfsaagu(Agn)cguucgUfuUfaacucsasa | UUGAGUUAAACGAACGUACUUGC | 4271 |
| AD-901420.1 | A-1701397.1 | 49 | uscsacu(Ghd)GfaUfGfUfauuugacugaL96 | A-1701398.1 | 178 | VPusCfsaguc(Agn)aauacaUfcCfagugasasg | CUUCACUGGAUGUAUUUGACUGC | 4272 |
| AD-901312.1 | A-1701181.1 | 50 | cscsucc(Ghd)AfaAfCfCfaugaacuuuaL96 | A-1701182.1 | 179 | VPusAfsaagu(Tgn)caugguUfuCfggaggscsc | GGCCUCCGAAACCAUGAACUUUC | 4273 |
| AD-901340.1 | A-1701237.1 | 51 | ususgag(Uhd)UfaAfAfCfgaacguacuaL96 | A-1701238.1 | 180 | VPusAfsguac(Ggn)uucguuUfaAfcucaasgsc | GCUUGAGUUAAACGAACGUACUU | 4274 |
| AD-901392.1 | A-1701341.1 | 52 | usgscua(Chd)UfgUfUfUfauccguaauaL96 | A-1701342.1 | 181 | VPusAfsuuac(Ggn)gauaaaCfaGfuagcascsc | GGUGCUACUGUUUAUCCGUAAUA | 4275 |
| AD-901327.1 | A-1701211.1 | 53 | cscsgca(Ghd)AfcGfUfGfuaaauguucaL96 | A-1701212.1 | 182 | VPusGfsaaca(Tgn)uuacacGfuCfugcggsasu | AUCCGCAGACGUGUAAAUGUUCC | 4276 |
| AD-901328.1 | A-1701213.1 | 54 | csgscag(Ahd)CfgUfGfUfaaauguuccaL96 | A-1701214.1 | 183 | VPusGfsgaac(Agn)uuuacaCfgUfcugcgsgsa | UCCGCAGACGUGUAAAUGUUCCU | 4277 |
| AD-901370.1 | A-1701297.1 | 55 | asgsaga(Ahd)GfaGfAfCfacauuguugaL96 | A-1701298.1 | 184 | VPusCfsaaca(Agn)ugugucUfcUfucucusus

c | GAAGAGAAGAGACACAUUGUUGG | 4278 |
| AD-901399.1 | A-1701355.1 | 56 | ascsagc(Ahd)CfaAfCfAfaaugugaauaL96 | A-1701356.1 | 185 | VPusAfsuuca(Cgn)auuuguUfgUfgcugusasg | CUACAGCACAACAAUGUGAAUG | 4279 |

TABLE 2A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA target sequence | SEQ ID NO: (mRNA target) |
|---|---|---|---|---|---|---|---|---|
| AD-901359.1 | A-1701275.1 | 57 | uscsuug(Chd)UfgCfUfAfaaucaccgaaL96 | A-1701276.1 | 186 | VPusUfscggu(Ggn)auuuagCfaGfcaagasasa | UUUCUUGCUGCUAAAUCACCGAG | 4280 |
| AD-901373.1 | A-1701303.1 | 58 | ascsacc(Ahd)UfuGfAfAfaccacuaguaL96 | A-1701304.1 | 187 | VPusAfscuag(Tgn)gguuucAfaUfggugusgsa | UCACACCAUUGAAACCACUAGUU | 4281 |
| AD-901332.1 | A-1701221.1 | 59 | gsasggc(Ahd)GfcUfUfGfaguuaaacgaL96 | A-1701222.1 | 188 | VPusCfsguuu(Agn)acucaaGfcUfgccucsgsc | GCGAGGCAGCUUGAGUUAAACGA | 4282 |
| AD-901311.1 | A-1701179.1 | 60 | gscsacu(Ghd)AfaAfCfUfuuucguccaaL96 | A-1701180.1 | 189 | VPusUfsggac(Ggn)aaaaguUfuCfagugcsgsa | UCGCACUGAAACUUUUCGUCCAA | 4283 |
| AD-901423.1 | A-1701403.1 | 61 | gsusuuu(Ahd)UfaUfAfCfgguacuuauaL96 | A-1701404.1 | 190 | VPusAfsuaag(Tgn)accguaUfaUfaaaacsasc | GUGUUUUAUAUACGGUACUUAUU | 4284 |
| AD-901374.1 | A-1701305.1 | 62 | csascca(Uhd)UfgAfAfAfccacuaguuaL96 | A-1701306.1 | 191 | VPusAfsacua(Ggn)ugguuuCfaAfuggugsusg | CACACCAUUGAAACCACUAGUUC | 4285 |
| AD-901319.1 | A-1701195.1 | 63 | asuscac(Chd)AfuGfCfAfgauuaugcgaL96 | A-1701196.1 | 192 | VPusCfsgcau(Agn)aucugcAfuGfgugausgsu | ACAUCACCAUGCAGAUUAUGCGG | 4286 |
| AD-901341.1 | A-1701239.1 | 64 | usgsagu(Uhd)AfaAfCfGfaacguacuuaL96 | A-1701240.1 | 193 | VPusAfsagua(Cgn)gucguuUfuAfacucasasg | CUUGAGUUAAACGAACGUACUUG | 4287 |
| AD-901422.1 | A-1701401.1 | 65 | gsasaag(Uhd)GfuUfUfUfauauacgguaL96 | A-1701402.1 | 194 | VPusAfsccgu(Agn)uauaaaAfcAfcuuucsusc | GAGAAAGUGUUUUAUAUACGGUA | 4288 |
| AD-901385.1 | A-1701327.1 | 66 | ascsagu(Chd)AfcUfAfGfcuuaucuugaL96 | A-1701328.1 | 195 | VPusCfsaaga(Tgn)aagcuaGfuGfacugusgsa | UGACAGUCACUAGCUUAUCUUGA | 4289 |
| AD-901391.1 | A-1701339.1 | 67 | gsusgcu(Ahd)CfuGfUfUfuauccguaaaL96 | A-1701340.1 | 196 | VPusUfsuacg(Ggn)auaaacAfgUfagcacsgsa | UGGUGCUACUGUUUAUCCGUAAU | 4290 |
| AD-901329.1 | A-1701215.1 | 68 | cscsugc(Ahd)AfaAfAfCfacagacucgaL96 | A-1701216.1 | 197 | VPusCfsgagu(Cgn)uguguuUfuUfgcaggsasa | UUCCUGCAAAAACACAGACUCGC | 4291 |
| AD-901331.1 | A-1701219.1 | 69 | csasaaa(Ahd)CfaCfAfGfacucgcguuaL96 | A-1701220.1 | 198 | VPusAfsacgc(Ggn)agucugUfgUfuuuugscsa | UGCAAAAACACAGACUCGCGUUG | 4292 |
| AD-901368.1 | A-1701293.1 | 70 | usgscug(Uhd)GfgAfCfUfugaguugggaL96 | A-1701294.1 | 199 | VPusCfsccaa(Cgn)ucaaguCfcAfcagcasgsu | ACUGCUGUGGACUUGAGUUGGGA | 4293 |
| AD-901364.1 | A-1701285.1 | 71 | gsusgcu(Ahd)AfuGfUfUfauugguguc aL96 | A-1701286.1 | 200 | VPusGfsacac(Cgn)aauaacAfuUfagcacsusg | CAGUGCUAAUGUUAUUGGUGUCU | 4294 |
| AD-901389.1 | A-1701335.1 | 72 | usgsgug(Chd)UfaCfUfGfuuuauccguaL96 | A-1701336.1 | 201 | VPusAfscgga(Tgn)aaacagUfaGfcaccasasu | AUUGGUGCUACUGUUUAUCCGUA | 4295 |
| AD-901421.1 | A-1701399.1 | 73 | asgsaaa(Ghd)UfgUfUfUfuauauacggaL96 | A-1701400.1 | 202 | VPusCfscgua(Tgn)auaaaaCfaCfuuucuscsu | AGAGAAAGUGUUUUAUAUACGGU | 4296 |
| AD-901380.1 | A-1701317.1 | 74 | asascua(Uhd)UfuAfUfUfgfagauguaucaL96 | A-1701318.1 | 203 | VPusGfsauac(Agn)ucucauAfaAfuaguusgsa | UCAACUAUUUAUGAGAUGUAUCU | 4297 |

TABLE 2A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA target sequence | SEQ ID NO: (mRNA target) |
|---|---|---|---|---|---|---|---|---|
| AD-901343.1 | A-1701243.1 | 75 | asgsuua(Ahd)AfcGfAfAfcguacuugcaL96 | A-1701244.1 | 204 | VPusGfscaag(Tgn)acguucGfuUfuaacuscsa | UGAGUUAAACGAACGUACUUGCA | 4298 |
| AD-901317.1 | A-1701191.1 | 76 | csasucu(Uhd)CfaAfGfCfcauccugugaL96 | A-1701192.1 | 205 | VPusCfsacag(Ggn)auggcuUfgAfagaugsusa | UACAUCUUCAAGCCAUCCUGUGU | 4299 |
| AD-901424.1 | A-1701405.1 | 77 | ususuuu(Uhd)UfuCfAfGfuauucuuggaL96 | A-1701406.1 | 206 | VPusCfscaag(Agn)auacugAfaAfaaaaascsc | GGUUUUUUUUCAGUAUUCUUGGU | 4300 |
| AD-901431.1 | A-1701419.1 | 78 | ususauc(Chd)GfuAfAfUfaauugugggaL96 | A-1701420.1 | 207 | VPusCfsccac(Agn)auuauuAfcGfgauaaasasc | GUUUAUCCGUAAUAAUUGUGGGG | 4301 |
| AD-901378.1 | A-1701313.1 | 79 | gsgsuac(Uhd)UfaUfUfUfaauaucccuaL96 | A-1701314.1 | 208 | VPusAfsggga(Tgn)auuaaaUfaAfguaccsgsu | ACGGUACUUAUUUAAUAUCCCUU | 4302 |
| AD-901434.1 | A-1701425.1 | 80 | csascgu(Chd)UfuUfGfUfcucuagugcaL96 | A-1701426.1 | 209 | VPusGfscacu(Agn)gagacaAfaGfacgugsasu | AUCACGUCUUUGUCUCUAGUGCA | 4303 |
| AD-901412.1 | A-1701381.1 | 81 | usgscaa(Ahd)AfaCfAfCfagacucgcgaL96 | A-1701382.1 | 210 | VPusCfsgcga(Ggn)ucugugUfuUfuugcasgsg | CCUGCAAAAACACAGACUCGCGU | 4304 |
| AD-901426.1 | A-1701409.1 | 82 | ascsuau(Uhd)UfaUfGfAfgauguaucuaL96 | A-1701410.1 | 211 | VPusAfsgaua(Cgn)aucucaUfaAfauagususg | CAACUAUUUAUGAGAUGUAUCUU | 4305 |
| AD-901322.1 | A-1701201.1 | 83 | asgsggg(Chd)AfaAfAfAfcgaaagcgcaL96 | A-1701202.1 | 212 | VPusGfscgcu(Tgn)ucguuuUfuGfccccususu | AAAGGGGCAAAAACGAAAGCGCA | 4306 |
| AD-901381.1 | A-1701319.1 | 84 | ususgcu(Chd)UfcUfUfAfuuuguaccgaL96 | A-1701320.1 | 213 | VPusCfsggua(Cgn)aaauaaGfaGfagcaasgsa | UCUUGCUCUCUUAUUUGUACCGG | 4307 |
| AD-901324.1 | A-1701205.1 | 85 | asusuug(Uhd)UfuGfUfAfcaagauccgaL96 | A-1701206.1 | 214 | VPusCfsggau(Cgn)uuguacAfaAfcaaausgsc | GCAUUUGUUUGUACAAGAUCCGC | 4308 |
| AD-901347.1 | A-1701251.1 | 86 | usgsgca(Ghd)AfuGfUfGfacaagccgaaL96 | A-1701252.1 | 215 | VPusUfscggc(Tgn)ugucacAfuCfugcaasgsu | ACUUGCAGAUGUGACAAGCCGAG | 4309 |
| AD-901379.1 | A-1701315.1 | 87 | csasacu(Ahd)UfuUfAfUfgagauguauaL96 | A-1701316.1 | 216 | VPusAfsuaca(Tgn)cucauaAfaUfaguugsasa | UUCAACUAUUUAUGAGAUGUAUC | 4310 |
| AD-901428.1 | A-1701413.1 | 88 | asasuuc(Uhd)AfcAfUfAfcuaaaucucaL96 | A-1701414.1 | 217 | VPusGfsagau(Tgn)uaguauGfuAfgaauuscsu | AGAAUUCUACAUACUAAAUCUCU | 4311 |
| AD-901371.1 | A-1701299.1 | 89 | asusguc(Chd)UfcAfCfAfccauugaaaaL96 | A-1701300.1 | 218 | VPusUfsuuca(Agn)ugguguGfaGfgacausasg | CUAUGUCCUCACACCAUUGAAAC | 4312 |
| AD-901408.1 | A-1701373.1 | 90 | ususguu(Uhd)GfuAfCfAfagauccgcaaL96 | A-1701374.1 | 219 | VPusUfsgcgg(Agn)ucuuguAfcAfaacaasasu | AUUUGUUUGUACAAGAUCCGCAG | 4313 |
| AD-901417.1 | A-1701391.1 | 91 | usasauc(Chd)AfgAfAfAfccugaaaugaL96 | A-1701392.1 | 220 | VPusCfsauuu(Cgn)agguuuCfuGfgauuasasg | CUUAAUCCAGAAACCUGAAAUGA | 4314 |
| AD-901400.1 | A-1701357.1 | 92 | gsasaaa(Ahd)AfaAfUfCfaguucgaggaL96 | A-1701358.1 | 221 | VPusCfscucg(Agn)acugauUfuUfuuuucsusu | AAGAAAAAAAAUCAGUUCGAGGA | 4315 |

TABLE 2A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA target sequence | SEQ ID NO: (mRNA target) |
|---|---|---|---|---|---|---|---|---|
| AD-901323.1 | A-1701203.1 | 93 | gsgsgca(Ahd)AfaAfCfGfaaagcgcaaaL96 | A-1701204.1 | 222 | VPusUfsugcg(Cgn)uuucguUfuUfugcccscsu | AGGGGCAAAAACGAAAGCGCAAG | 4316 |
| AD-901316.1 | A-1701189.1 | 94 | usgsaag(Uhd)UfcAfUfGfgaugucuauaL96 | A-1701190.1 | 223 | VPusAfsuaga(Cgn)auccauGfaAfcuucascsc | GGUGAAGUUCAUGGAUGUCUAUC | 4317 |
| AD-901315.1 | A-1701187.1 | 95 | csascga(Ahd)GfuGfGfUfgaaguucauaL96 | A-1701188.1 | 224 | VPusAfsugaa(Cgn)uucaccAfcUfucgugsasu | AUCACGAAGUGGUGAAGUUCAUG | 4318 |
| AD-901395.1 | A-1701347.1 | 96 | ascsguc(Uhd)UfuGfUfCfucuagugcaaL96 | A-1701348.1 | 225 | VPusUfsgcac(Tgn)agagacAfaAfgacgusgsa | UCACGUCUUUGUCUCUAGUGCAG | 4319 |
| AD-901318.1 | A-1701193.1 | 97 | asascau(Chd)AfcCfAfUfgcagauuauaL96 | A-1701194.1 | 226 | VPusAfsuaau(Cgn)ugcaugGfuGfauguusgsg | CCAACAUCACCAUGCAGAUUAUG | 4320 |
| AD-901390.1 | A-1701337.1 | 98 | gsgsugc(Uhd)AfcUfGfUfuuauccguaaL96 | A-1701338.1 | 227 | VPusUfsacgg(Agn)uaaacaGfuAfgcaccsasa | UUGGUGCUACUGUUUAUCCGUAA | 4321 |
| AD-901387.1 | A-1701331.1 | 99 | asasaua(Ghd)AfcAfUfUfgcuauucugaL96 | A-1701332.1 | 228 | VPusCfsagaa(Tgn)agcaauGfuCfuauuusLsa | UAAAAUAGACAUUGCUAUUCUGU | 4322 |
| AD-901307.1 | A-1701171.1 | 100 | ususccc(Chd)AfaAfUfCfacuguggauaL96 | A-1701172.1 | 229 | VPusAfsucca(Cgn)agugauUfuGfgggaasgsu | ACUUCCCCAAAUCACUGUGGAUU | 4323 |
| AD-901410.1 | A-1701377.1 | 101 | gsasucc(Ghd)CfaGfAfCfguguaaaugaL96 | A-1701378.1 | 230 | VPusCfsauuu(Agn)cacgucUfgCfggaucsusu | AAGAUCCGCAGACGUGUAAAUGU | 4324 |
| AD-901433.1 | A-1701423.1 | 102 | ususaac(Ahd)UfcAfCfGfucuuugucuaL96 | A-1701424.1 | 231 | VPusAfsgaca(Agn)agacguGfaUfguuaasusa | UAUUAACAUCACGUCUUUGUCUC | 4325 |
| AD-901308.1 | A-1701173.1 | 103 | asasagu(Ghd)AfgUfGfAfccugcuuuuaL96 | A-1701174.1 | 232 | VPusAfsaaag(Cgn)aggucaCfuCfacuuusgsc | GCAAAGUGAGUGACCUGCUUUUG | 4326 |
| AD-901414.1 | A-1701385.1 | 104 | asasaaa(Chd)AfcAfGfAfcucgcguugaL96 | A-1701386.1 | 233 | VPusCfsaacg(Cgn)gagucuGfuGfuuuuusgsc | GCAAAAACACAGACUCGCGUUGC | 4327 |
| AD-901309.1 | A-1701175.1 | 105 | csgsucg(Chd)AfcUfGfAfaacuuuucgaL96 | A-1701176.1 | 234 | VPusCfsgaaa(Agn)guuucaGfuGfcgacgscsc | GGCGUCGCACUGAAACUUUUCGU | 4328 |
| AD-901362.1 | A-1701281.1 | 106 | asascag(Uhd)GfcUfAfAfuguuauuggaL96 | A-1701282.1 | 235 | VPusCfscaau(Agn)acauuaGfcAfcuguusasa | UUAACAGUGCUAAUGUUAUUGGU | 4329 |
| AD-901397.1 | A-1701351.1 | 107 | ususcgu(Chd)CfaAfCfUfucugggcugaL96 | A-1701352.1 | 236 | VPusCfsagcc(Cgn)agaaguUfgGfacgaasasa | UUUUCGUCCAACUUCUGGGCUGU | 4330 |
| AD-901419.1 | A-1701395.1 | 108 | asusugg(Uhd)GfuCfUfUfcacuggaugaL96 | A-1701396.1 | 237 | VPusCfsaucc(Agn)gugaagAfcAfccaausasa | UUAUUGGUGUCUUCACUGGAUGU | 4331 |
| AD-901413.1 | A-1701383.1 | 109 | gscsaaa(Ahd)AfcAfCfAfgacucgcguaL96 | A-1701384.1 | 238 | VPusAfscgcg(Agn)gucuguGfuUfuuugcsasg | CUGCAAAAACACAGACUCGCGUU | 4332 |
| AD-901401.1 | A-1701359.1 | 110 | asasaaa(Uhd)CfaGfUfUfcgaggaaagaL96 | A-1701360.1 | 239 | VPusCfsuuuc(Cgn)ucgaacUfgAfuuuuususu | AAAAAAAUCAGUUCGAGGAAAGG | 4333 |

TABLE 2A-continued

Exemplary Human VEGF-A siRNA Modified Single Strands and Duplex Sequences

| Duplex Name | Sense Oligo Name | SEQ ID NO: (Sense) | Sense Sequence | Antisense Oligo Name | SEQ ID NO: (Antisense) | Antisense Sequence | mRNA target sequence | SEQ ID NO: (mRNA target) |
|---|---|---|---|---|---|---|---|---|
| AD-901411.1 | A-1701379.1 | ill | csasgac(Ghd)UfgUfAfAfauguuccugaL96 | A-1701380.1 | 240 | VPusCfsagga(Agn)cauuuaCfaCfgucugscsg | CGCAGACGUGUAAAUGUUCCUGC | 4334 |
| AD-901372.1 | A-1701301.1 | 112 | usgsucc(Uhd)CfaCfAfCfcauugaaacaL96 | A-1701302.1 | 241 | VPusGfsuuuc(Agn)auggugUfgAfggacasusa | UAUGUCCUCACACCAUUGAAACC | 4335 |
| AD-901425.1 | A-1701407.1 | 113 | ususuuu(Uhd)UfcAfGfUfauucuugguaL96 | A-1701408.1 | 242 | VPusAfsccaa(Ggn)aauacuGfaAfaaaaasasc | GUUUUUUUCAGUAUUCUUGGUU | 4336 |
| AD-901409.1 | A-1701375.1 | 114 | asgsauc(Chd)GfcAfGfAfcguguaaauaL96 | A-1701376.1 | 243 | VPusAfsuuua(Cgn)acgucuGfcGfgaucususg | CAAGAUCCGCAGACGUGUAAAUG | 4337 |
| AD-901418.1 | A-1701393.1 | 115 | cscscuc(Uhd)UfgGfAfAfuuggauucgaL96 | A-1701394.1 | 244 | VPusCfsgaau(Cgn)caauucCfaAfgagggsasc | GUCCCUCUUGGAAUUGGAUUCGC | 4338 |
| AD-901393.1 | A-1701343.1 | 116 | gsasuau(Uhd)AfaCfAfUfcacgucuuuaL96 | A-1701344.1 | 245 | VPusAfsaaga(Cgn)gugaugUfuAfauaucsusu | AAGAUAUUAACAUCACGUCUUUG | 4339 |
| AD-901388.1 | A-1701333.1 | 117 | ususggu(Ghd)CfuAfCfUfguuuauccgaL96 | A-1701334.1 | 246 | VPusCfsggau(Agn)aacaguAfgCfaccaasusa | UAUUGGUGCUACUGUUUAUCCGU | 4340 |
| AD-901404.1 | A-1701365.1 | 118 | asasggg(Ghd)CfaAfAfAfacgaaagcgaL96 | A-1701366.1 | 247 | VPusCfsgcuu(Tgn)cguuuuUfgCfcccuususc | GAAAGGGGCAAAAACGAAAGCGC | 4341 |
| AD-901346.1 | A-1701249.1 | 119 | csusugc(Ahd)GfaUfGfUfgacaagccgaL96 | A-1701250.1 | 248 | VPusCfsggcu(Tgn)gucacaUfcUfgcaagsusa | UACUUGCAGAUGUGACAAGCCGA | 4342 |
| AD-901403.1 | A-1701363.1 | 120 | asasauc(Ahd)GfuUfCfGfaggaaagggaL96 | A-1701364.1 | 249 | VPusCfsccuu(Tgn)ccucgaAfcUfgauuususu | AAAAAUCAGUUCGAGGAAAGGGA | 4343 |
| AD-901396.1 | A-1701349.1 | 121 | ascsuuu(Uhd)CfgUfCfCfaacuucuggaL96 | A-1701350.1 | 250 | VPusCfscaga(Agn)guuggaCfgAfaaagususu | AAACUUUUCGUCCAACUUCUGGG | 4344 |
| AD-901432.1 | A-1701421.1 | 122 | asusuaa(Chd)AfuCfAfCfgucuuugucaL96 | A-1701422.1 | 251 | VPusGfsacaa(Agn)gacgugAfuGfuuaausasu | AUAUUAACAUCACGUCUUUGUCU | 4345 |
| AD-901435.1 | A-1701427.1 | 123 | csgsucu(Uhd)UfgUfCfUfcuagugcagaL96 | A-1701428.1 | 252 | VPusCfsugca(Cgn)uagagaCfaAfagacgsusg | CACGUCUUUGUCUCUAGUGCAGU | 4346 |
| AD-901416.1 | A-1701389.1 | 124 | asascac(Ahd)GfaCfUfCfgcguugcaaaL96 | A-1701390.1 | 253 | VPusUfsugca(Agn)cgcgagUfcUfguguusus u | AAAACACAGACUCGCGUUGCAAG | 4347 |
| AD-901394.1 | A-1701345.1 | 125 | asusauu(Ahd)AfcAfUfCfacgucuuugaL96 | A-1701346.1 | 254 | VPusCfsaaag(Agn)cgugauGfuUfaauauscsu | AGAUAUUAACAUCACGUCUUUGU | 4348 |
| AD-901429.1 | A-1701415.1 | 126 | gsusuua(Uhd)CfcGfUfAfauaauugugaL96 | A-1701416.1 | 255 | VPusCfsacaa(Tgn)uauuacGfgAfuaaacsasg | CUGUUUAUCCGUAAUAAUUGUGG | 4349 |
| AD-901402.1 | A-1701361.1 | 127 | asasaau(Chd)AfgUfUfCfgaggaaaggaL96 | A-1701362.1 | 256 | VPusCfscuuu(Cgn)cucgaaCfuGfauuuususu | AAAAAAUCAGUUCGAGGAAAGGG | 4350 |
| AD-901430.1 | A-1701417.1 | 128 | ususuau(Chd)CfgUfAfAfuaauuguggaL96 | A-1701418.1 | 257 | VPusCfscaca(Agn)uuauuaCfgGfauaaascsa | UGUUUAUCCGUAAUAAUUGUGGG | 4351 |

TABLE 2A-continued

| Exemplary Human VEGF-A siRNA Modified Single Strands and Duplex Sequences | | | | | | | | |
|---|---|---|---|---|---|---|---|---|
| Duplex Name | Sense Oligo Name | SEQ ID NO: (Sense) | Sense Sequence | Antisense Oligo Name | SEQ ID NO: (Antisense) | Antisense Sequence | mRNA target sequence | SEQ ID NO: (mRNA target) |
| AD-901369.1 | A-1701295.1 | 129 | asgsgac(Ahd)UfuGfCfUfgugcuuuggaL96 | A-1701296.1 | 258 | VPusCfscaaa(Ggn)cacagcAfaUfguccusgsa | UCAGGACAUUGCUGUGCUUUGGG | 4352 |

TABLE 2B

| Exemplary Human VEGF-A siRNA Unmodified Single Strands and Duplex Sequences | | | | | | | | |
|---|---|---|---|---|---|---|---|---|
| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
| AD-901349.1 | A-1701255.1 | 259 | AAGACUGAUACAGAACGAUCA | 1796-1816 | A-1701256.1 | 388 | UGAUCGUUCUGUAUCAGUCUUUC | 1794-1816 |
| AD-901376.1 | A-1701309.1 | 260 | ACGGUACUUAUUUAAUAUCCA | 2961-2981 | A-1701310.1 | 389 | UGGAUATUAAAUAAGUACCGUAU | 2959-2981 |
| AD-901356.1 | A-1701269.1 | 261 | CAGAACAGUCCUUAAUCCAGA | 1858-1878 | A-1701270.1 | 390 | UCUGGAUUAAGGACUGUUCUGUC | 1856-1878 |
| AD-901355.1 | A-1701267.1 | 262 | CGACAGAACAGUCCUUAAUCA | 1855-1875 | A-1701268.1 | 391 | UGAUUAAGGACUGUUCUGUCGAU | 1853-1875 |
| AD-901407.1 | A-1701371.1 | 263 | GCAUUUGUUUGUACAAGAUCA | 1614-1634 | A-1701372.1 | 392 | UGAUCUTGUACAAACAAAUGCUU | 1612-1634 |
| AD-901367.1 | A-1701291.1 | 264 | UAUUGGUGUCUUCACUGGAUA | 2192-2212 | A-1701292.1 | 393 | UAUCCAGUGAAGACACCAAUAAC | 2190-2212 |
| AD-901352.1 | A-1701261.1 | 265 | ACUGAUACAGAACGAUCGAUA | 1799-1819 | A-1701262.1 | 394 | UAUCGATCGUUCUGUAUCAGUCU | 1797-1819 |
| AD-901348.1 | A-1701253.1 | 266 | AAAGACUGAUACAGAACGAUA | 1795-1815 | A-1701254.1 | 395 | UAUCGUTCUGUAUCAGUCUUUCC | 1793-1815 |
| AD-901354.1 | A-1701265.1 | 267 | AUACAGAACGAUCGAUACAGA | 1803-1823 | A-1701266.1 | 396 | UCUGUATCGAUCGUUCUGUAUCA | 1801-1823 |
| AD-901353.1 | A-1701263.1 | 268 | CUGAUACAGAACGAUCGAUAA | 1800-1820 | A-1701264.1 | 397 | UUAUCGAUCGUUCUGUAUCAGUC | 1798-1820 |
| AD-901375.1 | A-1701307.1 | 269 | GAGAAAGUGUUUUAUAUACGA | 2944-2964 | A-1701308.1 | 398 | UCGUAUAUAAAACACUUUCUCUU | 2942-2964 |
| AD-901345.1 | A-1701247.1 | 270 | ACGAACGUACUUGCAGAUGUA | 1700-1720 | A-1701248.1 | 399 | UACAUCTGCAAGUACGUUCGUUU | 1698-1720 |
| AD-901357.1 | A-1701271.1 | 271 | CUUGGAAUUGGAUUCGCCAUA | 1982-2002 | A-1701272.1 | 400 | UAUGGCGAAUCCAAUUCCAAGAG | 1980-2002 |
| AD-901334.1 | A-1701225.1 | 272 | GGCAGCUUGAGUUAAACGAAA | 1685-1705 | A-1701226.1 | 401 | UUUCGUTAACUCAAGCUGCCUC | 1683-1705 |

TABLE 2B-continued

| Exemplary Human VEGF-A siRNA Unmodified Single Strands and Duplex Sequences | | | | | | | | |
|---|---|---|---|---|---|---|---|---|
| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
| AD-901313.1 | A-1701183.1 | 273 | GGGCAGAAUCAUCACGAAGUA | 1138-1158 | A-1701184.1 | 402 | UACUUCGUGAUGAUUCUGCCCUC | 1136-1158 |
| AD-901344.1 | A-1701245.1 | 274 | UUAAACGAACGUACUUGCAGA | 1696-1716 | A-1701246.1 | 403 | UCUGCAAGUACGUUCGUUUAACU | 1694-1716 |
| AD-901366.1 | A-1701289.1 | 275 | GUUAUUGGUGUCUUCACUGGA | 2190-2210 | A-1701290.1 | 404 | UCCAGUGAAGACACCAAUAACAU | 2188-2210 |
| AD-901337.1 | A-1701231.1 | 276 | AGCUUGAGUUAAACGAACGUA | 1688-1708 | A-1701232.1 | 405 | UACGUUCGUUUAACUCAAGCUGC | 1686-1708 |
| AD-901335.1 | A-1701227.1 | 277 | GCAGCUUGAGUUAAACGAACA | 1686-1706 | A-1701228.1 | 406 | UGUUCGUUAACUCAAGCUGCCU | 1684-1706 |
| AD-901398.1 | A-1701353.1 | 278 | CGAAGUGGUGAAGUUCAUGGA | 1152-1172 | A-1701354.1 | 407 | UCCAUGAACUUCACCACUUCGUG | 1150-1172 |
| AD-901314.1 | A-1701185.1 | 279 | CAGAAUCAUCACGAAGUGGUA | 1141-1161 | A-1701186.1 | 408 | UACCACUUCGUGAUGAUUCUGCC | 1139-1161 |
| AD-901386.1 | A-1701329.1 | 280 | AAAAUAGACAUUGCUAUUCUA | 3361-3381 | A-1701330.1 | 409 | UAGAAUAGCAAUGUCUAUUUUAU | 3359-3381 |
| AD-901336.1 | A-1701229.1 | 281 | CAGCUUGAGUUAAACGAACGA | 1687-1707 | A-1701230.1 | 410 | UCGUUCGUUUAACUCAAGCUGCC | 1685-1707 |
| AD-901310.1 | A-1701177.1 | 282 | CGCACUGAAACUUUUCGUCCA | 648-668 | A-1701178.1 | 411 | UGGACGAAAAGUUUCAGUGCGAC | 646-668 |
| AD-901321.1 | A-1701199.1 | 283 | AGAUUAUGCGGAUCAAACCUA | 1352-1372 | A-1701200.1 | 412 | UAGGUUTGAUCCGCAUAAUCUGC | 1350-1372 |
| AD-901382.1 | A-1701321.1 | 284 | GCUCUCUUAUUUGUACCGGUA | 3096-3116 | A-1701322.1 | 413 | UACCGGTACAAAUAAGAGAGCAA | 3094-3116 |
| AD-901384.1 | A-1701325.1 | 285 | UGACAGUCACUAGCUUAUCUA | 3162-3182 | A-1701326.1 | 414 | UAGAUAAGCUAGUGACUGUCACC | 3160-3182 |
| AD-901339.1 | A-1701235.1 | 286 | CUUGAGUUAAACGAACGUACA | 1690-1710 | A-1701236.1 | 415 | UGUACGUUCGUUUAACUCAAGCU | 1688-1710 |
| AD-901363.1 | A-1701283.1 | 287 | AGUGCUAAUGUUAUUGGUGUA | 2181-2201 | A-1701284.1 | 416 | UACACCAAUAACAUUAGCACUGU | 2179-2201 |
| AD-901325.1 | A-1701207.1 | 288 | AUCCGCAGACGUGUAAAUGUA | 1631-1651 | A-1701208.1 | 417 | UACAUUTACACGUCUGCGGAUCU | 1629-1651 |
| AD-901350.1 | A-1701257.1 | 289 | AGACUGAUACAGAACGAUCGA | 1797-1817 | A-1701258.1 | 418 | UCGAUCGUUCUGUAUCAGUCUUU | 1795-1817 |
| AD-901365.1 | A-1701287.1 | 290 | UGUUAUUGGUGUCUUCACUGA | 2189-2209 | A-1701288.1 | 419 | UCAGUGAAGACACCAAUAACAUU | 2187-2209 |

TABLE 2B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
|---|---|---|---|---|---|---|---|---|
| AD-901306.1 | A-1701169.1 | 291 | GUGCUGGAAUUUGAUAUUCAA | 125-145 | A-1701170.1 | 420 | UUGAAUAUCAAAUUCCAGCACCG | 123-145 |
| AD-901361.1 | A-1701279.1 | 292 | UUGCUGCUAAAUCACCGAGCA | 2012-2032 | A-1701280.1 | 421 | UGCUCGGUGAUUUAGCAGCAAGA | 2010-2032 |
| AD-901320.1 | A-1701197.1 | 293 | CACCAUGCAGAUUAUGCGGAA | 1344-1364 | A-1701198.1 | 422 | UUCCGCAUAAUCUGCAUGGUGAU | 1342-1364 |
| AD-901405.1 | A-1701367.1 | 294 | GAAAGCAUUUGUUUGUACAAA | 1610-1630 | A-1701368.1 | 423 | UUUGUACAAACAAAUGCUUUCUC | 1608-1630 |
| AD-901338.1 | A-1701233.1 | 295 | GCUUGAGUUAAACGAACGUAA | 1689-1709 | A-1701234.1 | 424 | UUACGUTCGUUUAACUCAAGCUG | 1687-1709 |
| AD-901383.1 | A-1701323.1 | 296 | UCGGUGACAGUCACUAGCUUA | 3158-3178 | A-1701324.1 | 425 | UAAGCUAGUGACUGUCACCGAUC | 3156-3178 |
| AD-901333.1 | A-1701223.1 | 297 | AGGCAGCUUGAGUUAAACGAA | 1684-1704 | A-1701224.1 | 426 | UUCGUUTAACUCAAGCUGCCUCG | 1682-1704 |
| AD-901330.1 | A-1701217.1 | 298 | CUGCAAAAACACAGACUCGCA | 1653-1673 | A-1701218.1 | 427 | UGCGAGTCUGUGUUUUUGCAGGA | 1651-1673 |
| AD-901360.1 | A-1701277.1 | 299 | CUUGCUGCUAAAUCACCGAGA | 2011-2031 | A-1701278.1 | 428 | UCUCGGTGAUUUAGCAGCAAGAA | 2009-2031 |
| AD-901358.1 | A-1701273.1 | 300 | UUCUUGCUGCUAAAUCACCGA | 2009-2029 | A-1701274.1 | 429 | UCGGUGAUUUAGCAGCAAGAAAA | 2007-2029 |
| AD-901406.1 | A-1701369.1 | 301 | AAAGCAUUUGUUUGUACAAGA | 1611-1631 | A-1701370.1 | 430 | UCUUGUACAAACAAAUGCuuucu | 1609-1631 |
| AD-901326.1 | A-1701209.1 | 302 | UCCGCAGACGUGUAAAUGUUA | 1632-1652 | A-1701210.1 | 431 | UAACAUTUACACGUCUGCGGAUC | 1630-1652 |
| AD-901377.1 | A-1701311.1 | 303 | CGGUACUUAUUUAAUAUCCCA | 2962-2982 | A-1701312.1 | 432 | UGGGAUAUUAAAUAAGUACCGUA | 2960-2982 |
| AD-901351.1 | A-1701259.1 | 304 | GACUGAUACAGAACGAUCGAA | 1798-1818 | A-1701260.1 | 433 | UUCGAUCGUUCUGUAUCAGUCUU | 1796-1818 |
| AD-901415.1 | A-1701387.1 | 305 | AAAACACAGACUCGCGUUGCA | 1658-1678 | A-1701388.1 | 434 | UGCAACGCGAGUCUGUGUUUUUG | 1656-1678 |
| AD-901342.1 | A-1701241.1 | 306 | GAGUUAAACGAACGUACUUGA | 1693-1713 | A-1701242.1 | 435 | UCAAGUACGUUCGUUUAACUCAA | 1691-1713 |
| AD-901420.1 | A-1701397.1 | 307 | UCACUGGAUGUAUUUGACUGA | 2203-2223 | A-1701398.1 | 436 | UCAGUCAAAUACAUCCAGUGAAG | 2201-2223 |
| AD-901312.1 | A-1701181.1 | 308 | CCUCCGAAACCAUGAACUUUA | 1028-1048 | A-1701182.1 | 437 | UAAAGUTCAUGGUUUCGGAGGCC | 1026-1048 |

TABLE 2B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
|---|---|---|---|---|---|---|---|---|
| AD-901340.1 | A-1701237.1 | 309 | UUGAGUUAAACGAACGUACUA | 1691-1711 | A-1701238.1 | 438 | UAGUACGUUCGUUUAACUCAAGC | 1689-1711 |
| AD-901392.1 | A-1701341.1 | 310 | UGCUACUGUUUAUCCGUAAUA | 3482-3502 | A-1701342.1 | 439 | UAUUACGGAUAAACAGUAGCACC | 3480-3502 |
| AD-901327.1 | A-1701211.1 | 311 | CCGCAGACGUGUAAAUGUUCA | 1633-1653 | A-1701212.1 | 440 | UGAACAUUUACACGUCUGCGGAU | 1631-1653 |
| AD-901328.1 | A-1701213.1 | 312 | CGCAGACGUGUAAAUGUUCCA | 1634-1654 | A-1701214.1 | 441 | UGGAACAUUUACACGUCUGCGGA | 1632-1654 |
| AD-901370.1 | A-1701297.1 | 313 | AGAGAAGAGACACAUUGUUGA | 2673-2693 | A-1701298.1 | 442 | UCAACAAUGUGUCUCUUCUCUUC | 2671-2693 |
| AD-901399.1 | A-1701355.1 | 314 | ACAGCACAACAAAUGUGAAUA | 1407-1427 | A-1701356.1 | 443 | UAUUCACAUUUGUUGUGCUGUAG | 1405-1427 |
| AD-901359.1 | A-1701275.1 | 315 | UCUUGCUGCUAAAUCACCGAA | 2010-2030 | A-1701276.1 | 444 | UUCGGUGAUUUAGCAGCAAGAAA | 2008-2030 |
| AD-901373.1 | A-1701303.1 | 316 | ACACCAUUGAAACCACUAGUA | 2790-2810 | A-1701304.1 | 445 | UACUAGTGGUUUCAAUGGUGUGA | 2788-2810 |
| AD-901332.1 | A-1701221.1 | 317 | GAGGCAGCUUGAGUUAAACGA | 1683-1703 | A-1701222.1 | 446 | UCGUUUAACUCAAGCUGCCUCGC | 1681-1703 |
| AD-901311.1 | A-1701179.1 | 318 | GCACUGAAACUUUUCGUCCAA | 649-669 | A-1701180.1 | 447 | UUGGACGAAAAGUUUCAGUGCGA | 647-669 |
| AD-901423.1 | A-1701403.1 | 319 | GUUUUAUAUACGGUACUUAUA | 2952-2972 | A-1701404.1 | 448 | UAUAAGTACCGUAUAUAAAACAC | 2950-2972 |
| AD-901374.1 | A-1701305.1 | 320 | CACCAUUGAAACCACUAGUUA | 2791-2811 | A-1701306.1 | 449 | UAACUAGUGGUUUCAAUGGUGUG | 2789-2811 |
| AD-901319.1 | A-1701195.1 | 321 | AUCACCAUGCAGAUUAUGCGA | 1342-1362 | A-1701196.1 | 450 | UCGCAUAAUCUGCAUGGUGAUGU | 1340-1362 |
| AD-901341.1 | A-1701239.1 | 322 | UGAGUUAAACGAACGUACUUA | 1692-1712 | A-1701240.1 | 451 | UAAGUACGUUCGUUUAACUCAAG | 1690-1712 |
| AD-901422.1 | A-1701401.1 | 323 | GAAAGUGUUUUAUAUACGGUA | 2946-2966 | A-1701402.1 | 452 | UACCGUAUAUAAAACACUUUCUC | 2944-2966 |
| AD-901385.1 | A-1701327.1 | 324 | ACAGUCACUAGCUUAUCUUGA | 3164-3184 | A-1701328.1 | 453 | UCAAGATAAGCUAGUGACUGUCA | 3162-3184 |
| AD-901391.1 | A-1701339.1 | 325 | GUGCUACUGUUUAUCCGUAAA | 3481-3501 | A-1701340.1 | 454 | UUUACGGAUAAACAGUAGCACCA | 3479-3501 |
| AD-901329.1 | A-1701215.1 | 326 | CCUGCAAAAACACAGACUCGA | 1652-1672 | A-1701216.1 | 455 | UCGAGUCUGUGUUUUUGCAGGAA | 1650-1672 |

TABLE 2B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
|---|---|---|---|---|---|---|---|---|
| AD-901331.1 | A-1701219.1 | 327 | CAAAAACACAGACUCGCGUUA | 1656-1676 | A-1701220.1 | 456 | UAACGCGAGUCUGUGUUUUUGCA | 1654-1676 |
| AD-901368.1 | A-1701293.1 | 328 | UGCUGUGGACUUGAGUUGGGA | 2221-2241 | A-1701294.1 | 457 | UCCCAACUCAAGUCCACAGCAGU | 2219-2241 |
| AD-901364.1 | A-1701285.1 | 329 | GUGCUAAUGUUAUUGGUGUCA | 2182-2202 | A-1701286.1 | 458 | UGACACCAAUAACAUUAGCACUG | 2180-2202 |
| AD-901389.1 | A-1701335.1 | 330 | UGGUGCUACUGUUUAUCCGUA | 3479-3499 | A-1701336.1 | 459 | UACGGATAAACAGUAGCACCAAU | 3477-3499 |
| AD-901421.1 | A-1701399.1 | 331 | AGAAAGUGUUUUAUAUACGGA | 2945-2965 | A-1701400.1 | 460 | UCCGUATAUAAAACACUUUCUCU | 2943-2965 |
| AD-901380.1 | A-1701317.1 | 332 | AACUAUUUAUGAGAUGUAUCA | 3062-3082 | A-1701318.1 | 461 | UGAUACAUCUCAUAAAUAGUUGA | 3060-3082 |
| AD-901343.1 | A-1701243.1 | 333 | AGUUAAACGAACGUACUUGCA | 1694-1714 | A-1701244.1 | 462 | UGCAAGTACGUUCGUUUAACUCA | 1692-1714 |
| AD-901317.1 | A-1701191.1 | 334 | CAUCUUCAAGCCAUCCUGUGA | 1251-1271 | A-1701192.1 | 463 | UCACAGGAUGGCUUGAAGAUGUA | 1249-1271 |
| AD-901424.1 | A-1701405.1 | 335 | UUUUUUUUCAGUAUUCUUGGA | 3027-3047 | A-1701406.1 | 464 | UCCAAGAAUACUGAAAAAAACC | 3025-3047 |
| AD-901431.1 | A-1701419.1 | 336 | UUAUCCGUAAUAAUUGUGGGA | 3491-3511 | A-1701420.1 | 465 | UCCCACAAUUAUUACGGAUAAAC | 3489-3511 |
| AD-901378.1 | A-1701313.1 | 337 | GGUACUUAUUUAAUAUCCCUA | 2963-2983 | A-1701314.1 | 466 | UAGGGATAUUAAAUAAGUACCGU | 2961-2983 |
| AD-901434.1 | A-1701425.1 | 338 | CACGUCUUUGUCUCUAGUGCA | 3527-3547 | A-1701426.1 | 467 | UGCACUAGAGACAAAGACGUGAU | 3525-3547 |
| AD-901412.1 | A-1701381.1 | 339 | UGCAAAAACACAGACUCGCGA | 1654-1674 | A-1701382.1 | 468 | UCGCGAGUCUGUGUUUUUGCAGG | 1652-1674 |
| AD-901426.1 | A-1701409.1 | 340 | ACUAUUUAUGAGAUGUAUCUA | 3063-3083 | A-1701410.1 | 469 | UAGAUACAUCUCAUAAAUAGUUG | 3061-3083 |
| AD-901322.1 | A-1701201.1 | 341 | AGGGGCAAAAACGAAAGCGCA | 1484-1504 | A-1701202.1 | 470 | UGCGCUTUCGUUUUUGCCCCUUU | 1482-1504 |
| AD-901381.1 | A-1701319.1 | 342 | UUGCUCUCUUAUUUGUACCGA | 3094-3114 | A-1701320.1 | 471 | UCGGUACAAAUAAGAGAGCAAGA | 3092-3114 |
| AD-901324.1 | A-1701205.1 | 343 | AUUUGUUUGUACAAGAUCCGA | 1616-1636 | A-1701206.1 | 472 | UCGGAUCUUGUACAAACAAAUGC | 1614-1636 |
| AD-901347.1 | A-1701251.1 | 344 | UUGCAGAUGUGACAAGCCGAA | 1710-1730 | A-1701252.1 | 473 | UUCGGCTUGUCACAUCUGCAAGU | 1708-1730 |

TABLE 2B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
|---|---|---|---|---|---|---|---|---|
| AD-901379.1 | A-1701315.1 | 345 | CAACUAUUUAUGAGAUGUAUA | 3061-3081 | A-1701316.1 | 474 | UAUACAUCUCAUAAAUAGUUGAA | 3059-3081 |
| AD-901428.1 | A-1701413.1 | 346 | AAUUCUACAUACUAAAUCUCA | 3419-3439 | A-1701414.1 | 475 | UGAGAUTUAGUAUGUAGAAUUCU | 3417-3439 |
| AD-901371.1 | A-1701299.1 | 347 | AUGUCCUCACACCAUUGAAAA | 2782-2802 | A-1701300.1 | 476 | UUUUCAAUGGUGUGAGGACAUAG | 2780-2802 |
| AD-901408.1 | A-1701373.1 | 348 | UUGUUUGUACAAGAUCCGCAA | 1618-1638 | A-1701374.1 | 477 | UUGCGGAUCUUGUACAAACAAAU | 1616-1638 |
| AD-901417.1 | A-1701391.1 | 349 | UAAUCCAGAAACCUGAAAUGA | 1870-1890 | A-1701392.1 | 478 | UCAUUUCAGGUUUCUGGAUUAAG | 1868-1890 |
| AD-901400.1 | A-1701357.1 | 350 | GAAAAAAAAUCAGUUCGAGGA | 1456-1476 | A-1701358.1 | 479 | UCCUCGAACUGAUUUUUUUUCUU | 1454-1476 |
| AD-901323.1 | A-1701203.1 | 351 | GGGCAAAAACGAAAGCGCAAA | 1486-1506 | A-1701204.1 | 480 | UUUGCGCUUUCGUUUUUGCCCCU | 1484-1506 |
| AD-901316.1 | A-1701189.1 | 352 | UGAAGUUCAUGGAUGUCUAUA | 1160-1180 | A-1701190.1 | 481 | UAUAGACAUCCAUGAACUUCACC | 1158-1180 |
| AD-901315.1 | A-1701187.1 | 353 | CACGAAGUGGUGAAGUUCAUA | 1150-1170 | A-1701188.1 | 482 | UAUGAACUUCACCACUUCGUGAU | 1148-1170 |
| AD-901395.1 | A-1701347.1 | 354 | ACGUCUUUGUCUCUAGUGCAA | 3528-3548 | A-1701348.1 | 483 | UUGCACTAGAGACAAAGACGUGA | 3526-3548 |
| AD-901318.1 | A-1701193.1 | 355 | AACAUCACCAUGCAGAUUAUA | 1339-1359 | A-1701194.1 | 484 | UAUAAUCUGCAUGGUGAUGUUGG | 1337-1359 |
| AD-901390.1 | A-1701337.1 | 356 | GGUGCUACUGUUUAUCCGUAA | 3480-3500 | A-1701338.1 | 485 | UUACGGAUAAACAGUAGCACCAA | 3478-3500 |
| AD-901387.1 | A-1701331.1 | 357 | AAAUAGACAUUGCUAUUCUGA | 3362-3382 | A-1701332.1 | 486 | UCAGAATAGCAAUGUCUAUUUUA | 3360-3382 |
| AD-901307.1 | A-1701171.1 | 358 | UUCCCCAAAUCACUGUGGAUA | 278-298 | A-1701172.1 | 487 | UAUCCACAGUGAUUUGGGGAAGU | 276-298 |
| AD-901410.1 | A-1701377.1 | 359 | GAUCCGCAGACGUGUAAAUGA | 1630-1650 | A-1701378.1 | 488 | UCAUUUACACGUCUGCGGAUCUU | 1628-1650 |
| AD-901433.1 | A-1701423.1 | 360 | UUAACAUCACGUCUUUGUCUA | 3520-3540 | A-1701424.1 | 489 | UAGACAAAGACGUGAUGUUAAUA | 3518-3540 |
| AD-901308.1 | A-1701173.1 | 361 | AAAGUGAGUGACCUGCUUUUA | 415-435 | A-1701174.1 | 490 | UAAAAGCAGGUCACUCACUUUGC | 413-435 |

TABLE 2B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
|---|---|---|---|---|---|---|---|---|
| AD-901414.1 | A-1701385.1 | 362 | AAAAACACAGACUCGCGUUGA | 1657-1677 | A-1701386.1 | 491 | UCAACGCGAGUCUGUGUUUUUGC | 1655-1677 |
| AD-901309.1 | A-1701175.1 | 363 | CGUCGCACUGAAACUUUUCGA | 645-665 | A-1701176.1 | 492 | UCGAAAAGUUUCAGUGCGACGCC | 643-665 |
| AD-901362.1 | A-1701281.1 | 364 | AACAGUGCUAAUGUUAUUGGA | 2178-2198 | A-1701282.1 | 493 | UCCAAUAACAUUAGCACUGUUAA | 2176-2198 |
| AD-901397.1 | A-1701351.1 | 365 | UUCGUCCAACUUCUGGGCUGA | 661-681 | A-1701352.1 | 494 | UCAGCCCAGAAGUUGGACGAAAA | 659-681 |
| AD-901419.1 | A-1701395.1 | 366 | AUUGGUGUCUUCACUGGAUGA | 2193-2213 | A-1701396.1 | 495 | UCAUCCAGUGAAGACACCAAUAA | 2191-2213 |
| AD-901413.1 | A-1701383.1 | 367 | GCAAAAACACAGACUCGCGUA | 1655-1675 | A-1701384.1 | 496 | UACGCGAGUCUGUGUUUUUGCAG | 1653-1675 |
| AD-901401.1 | A-1701359.1 | 368 | AAAAAUCAGUUCGAGGAAAGA | 1460-1480 | A-1701360.1 | 497 | UCUUUCCUCGAACUGAUUUUUUU | 1458-1480 |
| AD-901411.1 | A-1701379.1 | 369 | CAGACGUGUAAAUGUUCCUGA | 1636-1656 | A-1701380.1 | 498 | UCAGGAACAUUUACACGUCUGCG | 1634-1656 |
| AD-901372.1 | A-1701301.1 | 370 | UGUCCUCACACCAUUGAAACA | 2783-2803 | A-1701302.1 | 499 | UGUUUCAAUGGUGUGAGGACAUA | 2781-2803 |
| AD-901425.1 | A-1701407.1 | 371 | UUUUUUUCAGUAUUCUUGGUA | 3028-3048 | A-1701408.1 | 500 | UACCAAGAAUACUGAAAAAAAC | 3026-3048 |
| AD-901409.1 | A-1701375.1 | 372 | AGAUCCGCAGACGUGUAAAUA | 1629-1649 | A-1701376.1 | 501 | UAUUUACACGUCUGCGGAUCUUG | 1627-1649 |
| AD-901418.1 | A-1701393.1 | 373 | CCCUCUUGGAAUUGGAUUCGA | 1978-1998 | A-1701394.1 | 502 | UCGAAUCCAAUUCCAAGAGGGAC | 1976-1998 |
| AD-901393.1 | A-1701343.1 | 374 | GAUAUUAACAUCACGUCUUUA | 3516-3536 | A-1701344.1 | 503 | UAAAGACGUGAUGUUAAUAUCUU | 3514-3536 |
| AD-901388.1 | A-1701333.1 | 375 | UUGGUGCUACUGUUUAUCCGA | 3478-3498 | A-1701334.1 | 504 | UCGGAUAAACAGUAGCACCAAUA | 3476-3498 |
| AD-901404.1 | A-1701365.1 | 376 | AAGGGGCAAAAACGAAAGCGA | 1483-1503 | A-1701366.1 | 505 | UCGCUUUCGUUUUUGCCCcuuuc | 1481-1503 |
| AD-901346.1 | A-1701249.1 | 377 | CUUGCAGAUGUGACAAGCCGA | 1709-1729 | A-1701250.1 | 506 | UCGGCUUGUCACAUCUGCAAGUA | 1707-1729 |
| AD-901403.1 | A-1701363.1 | 378 | AAAUCAGUUCGAGGAAAGGGA | 1462-1482 | A-1701364.1 | 507 | UCCCUUUCCUCGAACUGAUUUUU | 1460-1482 |
| AD-901396.1 | A-1701349.1 | 379 | ACUUUUCGUCCAACUUCUGGA | 657-677 | A-1701350.1 | 508 | UCCAGAAGUUGGACGAAAAGUUU | 655-677 |

TABLE 2B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
|---|---|---|---|---|---|---|---|---|
| AD-901432.1 | A-1701421.1 | 380 | AUUAACAUCACGUCUUUGUCA | 3519-3539 | A-1701422.1 | 509 | UGACAAAGACGUGAUGUUAAUAU | 3517-3539 |
| AD-901435.1 | A-1701427.1 | 381 | CGUCUUUGUCUCUAGUGCAGA | 3529-3549 | A-1701428.1 | 510 | UCUGCACUAGAGACAAAGACGUG | 3527-3549 |
| AD-901416.1 | A-1701389.1 | 382 | AACACAGACUCGCGUUGCAAA | 1660-1680 | A-1701390.1 | 511 | UUUGCAACGCGAGUCUGUGUUUU | 1658-1680 |
| AD-901394.1 | A-1701345.1 | 383 | AUAUUAACAUCACGUCUUUGA | 3517-3537 | A-1701346.1 | 512 | UCAAAGACGUGAUGUUAAUAUCU | 3515-3537 |
| AD-901429.1 | A-1701415.1 | 384 | GUUUAUCCGUAAUAAUUGUGA | 3489-3509 | A-1701416.1 | 513 | UCACAAUUAUUACGGAUAAACAG | 3487-3509 |
| AD-901402.1 | A-1701361.1 | 385 | AAAAUCAGUUCGAGGAAAGGA | 1461-1481 | A-1701362.1 | 514 | UCCUUUCCUCGAACUGAUUUUUU | 1459-1481 |
| AD-901430.1 | A-1701417.1 | 386 | UUUAUCCGUAAUAAUUGUGGA | 3490-3510 | A-1701418.1 | 515 | UCCACAAUUAUUACGGAUAAACA | 3488-3510 |
| AD-901369.1 | A-1701295.1 | 387 | AGGACAUUGCUGUGCUUUGGA | 2518-2538 | A-1701296.1 | 516 | UCCAAAGCACAGCAAUGUCCUGA | 2516-2538 |

TABLE 3A

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA target sequence | SEQ ID NO: (mRNA target) |
|---|---|---|---|---|---|---|---|---|
| AD-953340.1 | A-1701261.1 | 517 | ascsuga(Uhd)AfcAfGfAfacgaucgauaL96 | A-1068804.1 | 647 | VPusAfsucgAfuCfGfuucuGfuAfucagusesu | AGACUGAUACAGAACGAUCGAUA | 4353 |
| AD-953336.1 | A-1701253.1 | 518 | asasaga(Chd)UfgAfUfAfcagaacgauaL96 | A-1068796.1 | 648 | VPusAfsucgUfuCfUfguauCfaGfucuuuscsc | GGAAAGACUGAUACAGAACGAUC | 4354 |
| AD-953363.1 | A-1701307.1 | 519 | gsasgaa(Ahd)GfuGfUfUfuuauauacgaL96 | A-1070290.1 | 649 | VPusCfsguaUfaUfAfaaacAfcUfuucucsusu | AAGAGAAAGUGUUUUAUAUACGG | 4355 |
| AD-953338.1 | A-1701257.1 | 520 | asgsacu(Ghd)AfuAfCfAfgaacgaucgaL96 | A-1068800.1 | 650 | VPusCfsgauCfgUfUfcuguAfuCfagucusysu | AAAGACUGAUACAGAACGAUCGA | 4356 |
| AD-953367.1 | A-1701315.1 | 521 | csasacu(Ahd)UfuUfAfUfgagauguauaL96 | A-1070376.1 | 651 | VPusAfsuacAfuCfUfcauaAfaUfaguugsasa | UUCAACUAUUUAUGAGAUGUAUC | 4357 |
| AD-953337.1 | A-1701255.1 | 522 | asasgac(Uhd)GfaUfAfCfagaacgaucaL96 | A-1068798.1 | 652 | VPusGfsaucGfuUfCfuguaUfcAfgucuususc | GAAAGACUGAUACAGAACGAUCG | 4358 |
| AD-953342.1 | A-1701265.1 | 523 | asusaca(Ghd)AfaCfGfAfucgauacagaL96 | A-1068812.1 | 653 | VPusCfsuguAfuCfGfaucgUfuCfuguauscsa | UGAUACAGAACGAUCGAUACAGA | 4359 |

TABLE 3A-continued

Exemplary Human VEGF-A siRNA Modified Single Strands and Duplex Sequences

| Duplex Name | Sense Oligo Name | SEQ ID NO: (Sense) | Sense Sequence | Antisense Oligo Name | SEQ ID NO: (Antisense) | Antisense Sequence | mRNA target sequence | SEQ ID NO: (mRNA target) |
|---|---|---|---|---|---|---|---|---|
| AD-953350.1 | A-1701281.1 | 524 | asascag(Uhd)GfcUfAfAfuguuauuggaL96 | A-1069342.1 | 654 | VPusCfscaaUfaAfCfauuaGfcAfcuguusasa | UUAACAGUGCUAAUGUUAUUGGU | 4360 |
| AD-953352.1 | A-1701285.1 | 525 | gsusgcu(Ahd)AfuGfUfUfauuggugucaL96 | A-1069350.1 | 655 | VPusGfsacaCfcAfAfuaacAfuUfagcacsusg | CAGUGCUAAUGUUAUUGGUGUCU | 4361 |
| AD-953368.1 | A-1701317.1 | 526 | asascua(Uhd)UfuAfUfGfagauguaucaL96 | A-1070378.1 | 656 | VPusGfsauaCfaUfCfucauAfaAfuaguusgsa | UCAACUAUUUAUGAGAUGUAUCU | 4362 |
| AD-953344.1 | A-1701269.1 | 527 | csasgaa(Chd)AfgUfCfCfuuaauccagaL96 | A-1068918.1 | 657 | VPusCfsuggAfuUfAfaggaCfuGfuucugsusc | GACAGAACAGUCCUUAAUCCAGA | 4363 |
| AD-953339.1 | A-1701259.1 | 528 | gsascug(Ahd)UfaCfAfGfaacgaucgaaL96 | A-1068802.1 | 658 | VPusUfscgaUfcGfUfucugUfaUfcagucsusu | AAGACUGAUACAGAACGAUCGAU | 4364 |
| AD-953387.1 | A-1701355.1 | 529 | ascsagc(Ahd)CfaAfCfAfaaugugaauaL96 | A-1068170.1 | 659 | VPusAfsuucAfcAfUfuuguUfgUfgcugusasg | CUACAGCACAACAAAUGUGAAUG | 4365 |
| AD-953375.1 | A-1701331.1 | 530 | asasaua(Ghd)AfcAfUfUfgcuauucugaL96 | A-1070792.1 | 660 | VPusCfsagaAfuAfGfcaauGfuCfuauuususa | UAAAAUAGACAUUGCUAUUCUGU | 4366 |
| AD-953355.1 | A-1701291.1 | 531 | usasuug(Ghd)UfgUfCfUfucacuggauaL96 | A-1069370.1 | 661 | VPusAfsuccAfgUfGfaagaCfaCfcaauasasc | GUUAUUGGUGUCUUCACUGGAUG | 4367 |
| AD-953341.1 | A-1701263.1 | 532 | csusgau(Ahd)CfaGfAfAfcgaucgauaaL96 | A-1068806.1 | 662 | VPusUfsaucGfaUfCfguucUfgUfaucagsusc | GACUGAUACAGAACGAUCGAUAC | 4368 |
| AD-953370.1 | A-1701321.1 | 533 | gscsucu(Chd)UfuAfUfUfuguaccgguaL96 | A-1070446.1 | 663 | VPusAfsccgGfuAfCfaaauAfaGfagagcsasa | UUGCUCUCUUAUUUGUACCGGUU | 4369 |
| AD-953362.1 | A-1701305.1 | 534 | csascca(Uhd)UfgAfAfAfccacuaguuaL96 | A-1070096.1 | 664 | VPusAfsacuAfgUfGfguuuCfaAfuggugsusg | CACACCAUUGAAACCACUAGUUC | 4370 |
| AD-953322.1 | A-1701225.1 | 535 | gsgscag(Chd)UfuGfAfGfuuaaacgaaaL96 | A-1068596.1 | 665 | VPusUfsucgUfuUfAfacucAfaGfcugccsusc | GAGGCAGCUUGAGUUAAACGAAC | 4371 |
| AD-953332.1 | A-1701245.1 | 536 | ususaaa(Chd)GfaAfCfGfuacuugcagaL96 | A-1068618.1 | 666 | VPusCfsugcAfaGfUfacguUfcGfuuuaascsu | AGUUAAACGAACGUACUUGCAGA | 4372 |
| AD-953371.1 | A-1701323.1 | 537 | uscsggu(Ghd)AfcAfGfUfcacuagcuuaL96 | A-1070550.1 | 667 | VPusAfsagcUfaGfUfgacuGfuCfaccgasusc | GAUCGGUGACAGUCACUAGCUUA | 4373 |
| AD-953331.1 | A-1701243.1 | 538 | asgsuua(Ahd)AfcGfAfAfcguacuugcaL96 | A-1068614.1 | 668 | VPusGfscaaGfuAfCfguucGfuUfuaacuscsa | UGAGUUAAACGAACGUACUUGCA | 4374 |
| AD-953323.1 | A-1701227.1 | 539 | gscsagc(Uhd)UfgAfGfUfuaaacgaacaL96 | A-1068598.1 | 669 | VPusGfsuucGfuUfUfaacuCfaAfgcugcscsu | AGGCAGCUUGAGUUAAACGAACG | 4375 |
| AD-953351.1 | A-1701283.1 | 540 | asgsugc(Uhd)AfaUfGfUfuauugguguaL96 | A-1069348.1 | 670 | VPusAfscacCfaAfUfaacaUfuAfgcacusgsu | ACAGUGCUAAUGUUAUUGGUGUC | 4376 |
| AD-953386.1 | A-1701353.1 | 541 | csgsaag(Uhd)GfgUfGfAfaguucauggaL96 | A-1067728.1 | 671 | VPusCfscauGfaAfCfuucaCfcAfcuucgsusg | CACGAAGUGGUGAAGUUCAUGGA | 4377 |

TABLE 3A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA target sequence | SEQ ID NO: (mRNA target) |
|---|---|---|---|---|---|---|---|---|
| AD-953394.1 | A-1701369.1 | 542 | asasagc(Ahd)UfuUfGfUfuuguacaagaL96 | A-1068448.1 | 672 | VPusCfsuugUfaCfAfaacaAfaUfgcuuuscsu | AGAAAGCAUUUGUUUGUACAAGA | 4378 |
| AD-953359.1 | A-1701299.1 | 543 | asusguc(Chd)UfcAfCfAfccauugaaaaL96 | A-1070078.1 | 673 | VPusUfsuucAfaUfGfguguGfaGfgacausasg | CUAUGUCCUCACACCAUUGAAAC | 4379 |
| AD-953329.1 | A-1701239.1 | 544 | usgsagu(Uhd)AfaAfCfGfaacguacuuaL96 | A-1068610.1 | 674 | VPusAfsaguAfcGfUfucguUfuAfacucasasg | CUUGAGUUAAACGAACGUACUUG | 4380 |
| AD-953361.1 | A-1701303.1 | 545 | ascsacc(Ahd)UfuGfAfAfaccacuaguaL96 | A-1070094.1 | 675 | VPusAfscuaGfuGfGfuuucAfaUfggugusgsa | UCACACCAUUGAAACCACUAGUU | 4381 |
| AD-953319.1 | A-1701219.1 | 546 | csasaaa(Ahd)CfaCfAfGfacucgcguuaL96 | A-1068538.1 | 676 | VPusAfsacgCfgAfGfucugUfgUfuuuugscsa | UGCAAAAACACAGACUCGCGUUG | 4382 |
| AD-953360.1 | A-1701301.1 | 547 | usgsucc(Uhd)CfaCfAfCfcauugaaacaL96 | A-1070080.1 | 677 | VPusGfsuuuCfaAfUfggugUfgAfggacasusa | UAUGUCCUCACACCAUUGAAACC | 4383 |
| AD-953324.1 | A-1701229.1 | 548 | csasgcu(Uhd)GfaGfUfUfaaacgaacgaL96 | A-1068600.1 | 678 | VPusCfsguuCfgUfUfuaacUfcAfagcugscsc | GGCAGCUUGAGUUAAACGAACGU | 4384 |
| AD-953378.1 | A-1701337.1 | 549 | gsgsugc(Uhd)AfcUfGfUfuuauccguaaL96 | A-1070874.1 | 679 | VPusUfsacgGfaUfAfaacaGfuAfgcaccsasa | UUGGUGCUACUGUUUAUCCGUAA | 4385 |
| AD-953369.1 | A-1701319.1 | 550 | ususgcu(Chd)UfcUfUfAfuuuguaccgaL96 | A-1070442.1 | 680 | VPusCfsgguAfcAfAfauaaGfaGfagcaasgsa | UCUUGCUCUCUUAUUUGUACCGG | 4386 |
| AD-953347.1 | A-1701275.1 | 551 | uscsuug(Chd)UfgCfUfAfaaucaccgaaL96 | A-1069188.1 | 681 | VPusUfscggUfgAfUfuuagCfaGfcaagasasa | UUUCUUGCUGCUAAAUCACCGAG | 4387 |
| AD-953365.1 | A-1701311.1 | 552 | csgsgua(Chd)UfuAfUfUfuaauaucccaL96 | A-1070326.1 | 682 | VPusGfsggaUfaUfUfaaauAfaGfuaccgsusa | UACGGUACUUAUUUAAUAUCCCU | 4388 |
| AD-953374.1 | A-1701329.1 | 553 | asasaau(Ahd)GfaCfAfUfugcuauucuaL96 | A-1070790.1 | 683 | VPusAfsgaaUfaGfCfaaugUfcUfauuuusasu | AUAAAAUAGACAUUGCUAUUCUG | 4389 |
| AD-953384.1 | A-1701349.1 | 554 | ascsuuu(Uhd)CfgUfCfCfaacuucuggaL96 | A-1067266.1 | 684 | VPusCfscagAfaGfUfuggaCfgAfaaagususu | AAACUUUUCGUCCAACUUCUGGG | 4390 |
| AD-953376.1 | A-1701333.1 | 555 | ususggu(Ghd)CfuAfCfUfguuuauccgaL96 | A-1070870.1 | 685 | VPusCfsggaUfaAfAfcaguAfgCfaccaasusa | UAUUGGUGCUACUGUUUAUCCGU | 4391 |
| AD-953354.1 | A-1701289.1 | 556 | gsusuau(Uhd)GfgUfGfUfcuucacuggaL96 | A-1069366.1 | 686 | VPusCfscagUfgAfAfgacaCfcAfauaacsasu | AUGUUAUUGGUGUCUUCACUGGA | 4392 |
| AD-953385.1 | A-1701351.1 | 557 | ususcgu(Chd)CfaAfCfUfucugggcugaL96 | A-1067274.1 | 687 | VPusCfsagcCfcAfGfaaguUfgGfacgaasasa | UUUUCGUCCAACUUCUGGGCUGU | 4393 |
| AD-953346.1 | A-1701273.1 | 558 | ususcuu(Ghd)CfuGfCfUfaaaucaccgaL96 | A-1069186.1 | 688 | VPusCfsgguGfaUfUfuagcAfgCfaagaasasa | UUUUCUUGCUGCUAAAUCACCGA | 4394 |
| AD-953366.1 | A-1701313.1 | 559 | gsgsuac(Uhd)UfaUfUfUfaauaucccuaL96 | A-1070328.1 | 689 | VPusAfsgggAfuAfUfuaaaUfaAfguaccsgsu | ACGGUACUUAUUUAAUAUCCCUU | 4395 |

TABLE 3A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA target sequence | SEQ ID NO: (mRNA target) |
|---|---|---|---|---|---|---|---|---|
| AD-953382.1 | A-1701345.1 | 560 | asusauu(Ahd)AfcAfUfCfacgucuuugaL96 | A-1070912.1 | 690 | VPusCfsaaaGfaCfGfugauGfuUfaauauscsu | AGAUAUUAACAUCACGUCUUUGU | 4396 |
| AD-953320.1 | A-1701221.1 | 561 | gsasggc(Ahd)GfcUfUfGfaguuaaacgaL96 | A-1068592.1 | 691 | VPusCfsguuUfaAfCfucaaGfcUfgccucsgsc | GCGAGGCAGCUUGAGUUAAACGA | 4397 |
| AD-953379.1 | A-1701339.1 | 562 | gsusgcu(Ahd)CfuGfUfUfuauccguaaaL96 | A-1070876.1 | 692 | VPusUfsuacGfgAfUfaaacAfgUfagcacscsa | UGGUGCUACUGUUUAUCCGUAAU | 4398 |
| AD-953321.1 | A-1701223.1 | 563 | asgsgca(Ghd)CfuUfGfAfguuaaacgaaL96 | A-1068594.1 | 693 | VPusUfscguUfuAfAfcucaAfgCfugccuscsg | CGAGGCAGCUUGAGUUAAACGAA | 4399 |
| AD-953377.1 | A-1701335.1 | 564 | usgsgug(Chd)UfaCfUfGfuuuauccguaL96 | A-1070872.1 | 694 | VPusAfscggAfuAfAfacagUfaGfcaccasasu | AUUGGUGCUACUGUUUAUCCGUA | 4400 |
| AD-953392.1 | A-1701365.1 | 565 | asasggg(Ghd)CfaAfAfAfacgaaagcgaL96 | A-1700876.1 | 695 | VPusCfsgcuUfuCfGfuuuuUfgCfcccuususc | GAAAGGGGCAAAAACGAAAGCGC | 4401 |
| AD-953373.1 | A-1701327.1 | 566 | ascsagu(Chd)AfcUfAfGfcuuaucuugaL96 | A-1070562.1 | 696 | VPusCfsaagAfuAfAfgcuaGfuGfacuguscsa | UGACAGUCACUAGCUUAUCUUGA | 4402 |
| AD-953364.1 | A-1701309.1 | 567 | ascsggu(Ahd)CfuUfAfUfuuaauauccaL96 | A-1070324.1 | 697 | VPusGfsgauAfuUfAfaauaAfgUfaccgusasu | AUACGGUACUUAUUUAAUAUCCC | 4403 |
| AD-953330.1 | A-1701241.1 | 568 | gsasguu(Ahd)AfaCfGfAfacguacuugaL96 | A-1068612.1 | 698 | VPusCfsaagUfaCfGfuucgUfuUfaacucsasa | UUGAGUUAAACGAACGUACUUGC | 4404 |
| AD-953353.1 | A-1701287.1 | 569 | usgsuua(Uhd)UfgGfUfGfucuucacugaL96 | A-1069364.1 | 699 | VPusCfsaguGfaAfGfacaccCfaAfuaacasusu | AAUGUUAUUGGUGUCUUCACUGG | 4405 |
| AD-953343.1 | A-1701267.1 | 570 | csgsaca(Ghd)AfaCfAfGfuccuuaaucaL96 | A-1068912.1 | 700 | VPusGfsauuAfaGfGfacugUfuCfugucgsasu | AUCGACAGAACAGUCCUUAAUCC | 4406 |
| AD-953390.1 | A-1701361.1 | 571 | asasaau(Chd)AfgUfUfCfgaggaaaggaL96 | A-1700873.1 | 701 | VPusCfscuuUfcCfUfcgaaCfuGfauuuususu | AAAAAAUCAGUUCGAGGAAAGGG | 4407 |
| AD-953345.1 | A-1701271.1 | 572 | csusugg(Ahd)AfuUfGfGfauucgccauaL96 | A-1069132.1 | 702 | VPusAfsuggCfgAfAfuccaAfuUfccaagsasg | CUCUUGGAAUUGGAUUCGCCAUU | 4408 |
| AD-953358.1 | A-1701297.1 | 573 | asgsaga(Ahd)GfaGfAfCfacauuguugaL96 | A-1069954.1 | 703 | VPusCfsaacAfaUfGfugucUfcUfucucususc | GAAGAGAAGAGACACAUUGUUGG | 4409 |
| AD-953383.1 | A-1701347.1 | 574 | ascsguc(Uhd)UfuGfUfCfucuagugcaaL96 | A-1070934.1 | 704 | VPusUfsgcaCfuAfGfagacAfaAfgacgusgsa | UCACGUCUUUGUCUCUAGUGCAG | 4410 |
| AD-953372.1 | A-1701325.1 | 575 | usgsaca(Ghd)UfcAfCfUfagcuuaucuaL96 | A-1070558.1 | 705 | VPusAfsgauAfaGfCfuaguGfaCfugucascsc | GGUGACAGUCACUAGCUUAUCUU | 4411 |
| AD-953328.1 | A-1701237.1 | 576 | ususgag(Uhd)UfaAfAfCfgaacguacuaL96 | A-1068608.1 | 706 | VPusAfsguaCfgUfUfcguuUfaAfcucaasgsc | GCUUGAGUUAAACGAACGUACUU | 4412 |
| AD-953393.1 | A-1701367.1 | 577 | gsasaag(Chd)AfuUfUfGfuuuguacaaaL96 | A-1068446.1 | 707 | VPusUfsuguAfcAfAfacaaAfuGfcuuucsusc | GAGAAAGCAUUUGUUUGUACAAG | 4413 |

TABLE 3A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA target sequence | SEQ ID NO: (mRNA target) |
|---|---|---|---|---|---|---|---|---|
| AD-953307.1 | A-1701195.1 | 578 | asuscac(Chd)AfuGfCfAfgauuaugcgaL96 | A-1068040.1 | 708 | VPusCfsgcaUfaAfUfcugcAfuGfgugausgsu | ACAUCACCAUGCAGAUUAUGCGG | 4414 |
| AD-953308.1 | A-1701197.1 | 579 | csascca(Uhd)GfcAfGfAfuuaugcggaaL96 | A-1068044.1 | 709 | VPusUfsccgCfaUfAfaucuGfcAfuggugsasu | AUCACCAUGCAGAUUAUGCGGAU | 4415 |
| AD-953327.1 | A-1701235.1 | 580 | csusuga(Ghd)UfuAfAfAfcgaacguacaL96 | A-1068606.1 | 710 | VPusGfsuacGfuUfCfguuuAfaCfucaagscsu | AGCUUGAGUUAAACGAACGUACU | 4416 |
| AD-953335.1 | A-1701251.1 | 581 | ususgca(Ghd)AfuGfUfGfacaagccgaaL96 | A-1068646.1 | 711 | VPusUfscggCfuUfGfucacAfuCfugcaasgsu | ACUUGCAGAUGUGACAAGCCGAG | 4417 |
| AD-953414.1 | A-1701409.1 | 582 | ascsuau(Uhd)UfaUfGfAfgauguaucuaL96 | A-1070380.1 | 712 | VPusAfsgauAfcAfUfcucaUfaAfauagususg | CAACUAUUUAUGAGAUGUAUCUU | 4418 |
| AD-953412.1 | A-1701405.1 | 583 | ususuuu(Uhd)UfuCfAfGfuauucuuggaL96 | A-1700897.1 | 713 | VPusCfscaaGfaAfUfacugAfaAfaaaaascsc | GGUUUUUUUUCAGUAUUCUUGGU | 4419 |
| AD-953411.1 | A-1701403.1 | 584 | gsusuuu(Ahd)UfaUfAfCfgguacuuauaL96 | A-1070306.1 | 714 | VPusAfsuaaGfuAfCfcguaUfaUfaaaacsasc | GUGUUUUAUAUACGGUACUUAUU | 4420 |
| AD-953410.1 | A-1701401.1 | 585 | gsasaag(Uhd)GfuUfUfUfauauacgguaL96 | A-1070294.1 | 715 | VPusAfsccgUfaUfAfuaaaAfcAfcuuucsusc | GAGAAAGUGUUUUAUAUACGGUA | 4421 |
| AD-953408.1 | A-1701397.1 | 586 | uscsacu(Ghd)GfaUfGfUfauuugacugaL96 | A-1069392.1 | 716 | VPusCfsaguCfaAfAfuacaUfcCfagugasasg | CUUCACUGGAUGUAUUUGACUGC | 4422 |
| AD-953326.1 | A-1701233.1 | 587 | gscsuug(Ahd)GfuUfAfAfacgaacguaaL96 | A-1068604.1 | 717 | VPusUfsacgUfuCfGfuuuaAfcUfcaagcsusg | CAGCUUGAGUUAAACGAACGUAC | 4423 |
| AD-953300.1 | A-1701181.1 | 588 | cscsucc(Ghd)AfaAfCfCfaugaacuuuaL96 | A-1067482.1 | 718 | VPusAfsaagUfuCfAfugguUfuCfggaggscsc | GGCCUCCGAAACCAUGAACUUUC | 4424 |
| AD-953389.1 | A-1701359.1 | 589 | asasaaa(Uhd)CfaGfUfUfcgaggaaagaL96 | A-1700871.1 | 719 | VPusCfsuuuCfcUfCfgaacUfgAfuuuuususu | AAAAAAAUCAGUUCGAGGAAAGG | 4425 |
| AD-953415.1 | A-1701411.1 | 590 | gsasgaa(Uhd)UfcUfAfCfauacuaaauaL96 | A-1070816.1 | 720 | VPusAfsuuuAfgUfAfuguaGfaAfuucucsusa | UAGAGAAUUCUACAUACUAAAUC | 4426 |
| AD-953309.1 | A-1701199.1 | 591 | asgsauu(Ahd)UfgCfGfGfaucaaaccuaL96 | A-1068060.1 | 721 | VPusAfsgguUfuGfAfuccgCfaUfaaucusgsc | GCAGAUUAUGCGGAUCAAACCUC | 4427 |
| AD-953391.1 | A-1701363.1 | 592 | asasauc(Ahd)GfuUfCfGfaggaaagggaL96 | A-1068240.1 | 722 | VPusCfsccuUfuCfCfucgaAfcUfgauuususu | AAAAAUCAGUUCGAGGAAAGGGA | 4428 |
| AD-953395.1 | A-1701371.1 | 593 | gscsauu(Uhd)GfuUfUfGfuacaagaucaL96 | A-1068454.1 | 723 | VPusGfsaucUfuGfUfacaaAfcAfaaugcsusu | AAGCAUUUGUUUGUACAAGAUCC | 4429 |
| AD-953303.1 | A-1701187.1 | 594 | csascga(Ahd)GfuGfGfUfgaaguucauaL96 | A-1067724.1 | 724 | VPusAfsugaAfcUfUfcaccAfcUfucgugsasu | AUCACGAAGUGGUGAAGUUCAUG | 4430 |
| AD-953405.1 | A-1701391.1 | 595 | usasauc(Chd)AfgAfAfAfccugaaaugaL96 | A-1068942.1 | 725 | VPusCfsauuUfcAfGfguuuCfuGfgauuasasg | CUUAAUCCAGAAACCUGAAAUGA | 4431 |

TABLE 3A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA target sequence | SEQ ID NO: (mRNA target) |
|---|---|---|---|---|---|---|---|---|
| AD-953305.1 | A-1701191.1 | 596 | csasucu(Uhd)CfaAfGfCfcauccugugaL96 | A-1067926.1 | 726 | VPusCfsacaGfgAfUfggcuUfgAfagaugsusa | UACAUCUUCAAGCCAUCCUGUGU | 4432 |
| AD-953380.1 | A-1701341.1 | 597 | usgscua(Chd)UfgUfUfUfauccguaauaL96 | A-1070878.1 | 727 | VPusAfsuuaCfgGfAfuaaaCfaGfuagcascsc | GGUGCUACUGUUUAUCCGUAAUA | 4433 |
| AD-953349.1 | A-1701279.1 | 598 | ususgcu(Ghd)CfuAfAfAfucaccgagcaL96 | A-1069192.1 | 728 | VPusGfscucGfgUfGfauuuAfgCfagcaasgsa | UCUUGCUGCUAAAUCACCGAGCC | 4434 |
| AD-953381.1 | A-1701343.1 | 599 | gsasuau(Uhd)AfaCfAfUfcacgucuuuaL96 | A-1070910.1 | 729 | VPusAfsaagAfcGfUfgaugUfuAfauaucsusu | AAGAUAUUAACAUCACGUCUUUG | 4435 |
| AD-953318.1 | A-1701217.1 | 600 | csusgca(Ahd)AfaAfCfAfcagacucgcaL96 | A-1068532.1 | 730 | VPusGfscgaGfuCfUfguguUfuUfugcagsgsa | UCCUGCAAAAACACAGACUCGCG | 4436 |
| AD-953348.1 | A-1701277.1 | 601 | csusugc(Uhd)GfcUfAfAfaucaccgagaL96 | A-1069190.1 | 731 | VPusCfsucgGfuGfAfuuuaGfcAfgcaagsasa | UUCUUGCUGCUAAAUCACCGAGC | 4437 |
| AD-953409.1 | A-1701399.1 | 602 | asgsaaa(Ghd)UfgUfUfUfuauacggaL96 | A-1070292.1 | 732 | VPusCfscguAfuAfUfaaaaCfaCfuuucuscsu | AGAGAAAGUGUUUUAUAUACGGU | 4438 |
| AD-953306.1 | A-1701193.1 | 603 | asascau(Chd)AfcCfAfUfgcagauuauaL96 | A-1068034.1 | 733 | VPusAfsuaaUfcUfGfcaugGfuGfauguusgsg | CCAACAUCACCAUGCAGAUUAUG | 4439 |
| AD-953316.1 | A-1701213.1 | 604 | csgscag(Ahd)CfgUfGfUfaaauguuccaL96 | A-1068494.1 | 734 | VPusGfsgaaCfaUfUfuacaCfgUfcugcgsgsa | UCCGCAGACGUGUAAAUGUUCCU | 4440 |
| AD-953325.1 | A-1701231.1 | 605 | asgscuu(Ghd)AfgUfUfAfaacgaacguaL96 | A-1068602.1 | 735 | VPusAfscguUfcGfUfuuaaCfuCfaagcusgsc | GCAGCUUGAGUUAAACGAACGUA | 4441 |
| AD-953299.1 | A-1701179.1 | 606 | gscsacu(Ghd)AfaAfCfUfuuucguccaaL96 | A-1067250.1 | 736 | VPusUfsggaCfgAfAfaaguUfuCfagugcsgsa | UCGCACUGAAACUUUUCGUCCAA | 4442 |
| AD-953416.1 | A-1701413.1 | 607 | asasuuc(Uhd)AfcAfUfAfcuaaaucucaL96 | A-1070822.1 | 737 | VPusGfsagaUfuUfAfguauGfuAfgaauuscsu | AGAAUUCUACAUACUAAAUCUCU | 4443 |
| AD-953315.1 | A-1701211.1 | 608 | cscsgca(Ghd)AfcGfUfGfuaaauguucaL96 | A-1068492.1 | 738 | VPusGfsaacAfuUfUfacacGfuCfugcggsasu | AUCCGCAGACGUGUAAAUGUUCC | 4444 |
| AD-953314.1 | A-1701209.1 | 609 | uscscgc(Ahd)GfaCfGfUfguaaauguuaL96 | A-1068490.1 | 739 | VPusAfsacaUfuUfAfcacgUfcUfgcggasusc | GAUCCGCAGACGUGUAAAUGUUC | 4445 |
| AD-953298.1 | A-1701177.1 | 610 | csgscac(Uhd)GfaAfAfCfuuuucguccaL96 | A-1067248.1 | 740 | VPusGfsgacGfaAfAfaguuUfcAfgugcgsasc | GUCGCACUGAAACUUUUCGUCCA | 4446 |
| AD-953406.1 | A-1701393.1 | 611 | cscscuc(Uhd)UfgGfAfAfuuggauucgaL96 | A-1069124.1 | 741 | VPusCfsgaaUfcCfAfauucCfaAfgagggsasc | GUCCCUCUUGGAAUUGGAUUCGC | 4447 |
| AD-953399.1 | A-1701379.1 | 612 | csasgac(Ghd)UfgUfAfAfauguuccugaL96 | A-1068498.1 | 742 | VPusCfsaggAfaCfAfuuuaCfaCfgucugscsg | CGCAGACGUGUAAAUGUUCCUGC | 4448 |
| AD-953333.1 | A-1701247.1 | 613 | ascsgaa(Chd)GfuAfCfUfugcagauguaL96 | A-1068626.1 | 743 | VPusAfscauCfuGfCfaaguAfcGfuucgususu | AAACGAACGUACUUGCAGAUGUG | 4449 |

TABLE 3A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA target sequence | SEQ ID NO: (mRNA target) |
|---|---|---|---|---|---|---|---|---|
| AD-953313.1 | A-1701207.1 | 614 | asusccg(Chd)AfgAfCfGfuguaaauguaL96 | A-1068488.1 | 744 | VPusAfscauUfuAfCfacguCfuGfcggauscsu | AGAUCCGCAGACGUGUAAAUGUU | 4450 |
| AD-953302.1 | A-1701185.1 | 615 | csasgaa(Uhd)CfaUfCfAfcgaagugguaL96 | A-1067706.1 | 745 | VPusAfsccaCfuUfCfgugaUfgAfuucugscsc | GGCAGAAUCAUCACGAAGUGGUG | 4451 |
| AD-953317.1 | A-1701215.1 | 616 | cscsugc(Ahd)AfaAfAfCfacagacucgaL96 | A-1068530.1 | 746 | VPusCfsgagUfcUfGfuguuUfuUfgcaggsasa | UUCCUGCAAAAACACAGACUCGC | 4452 |
| AD-953357.1 | A-1701295.1 | 617 | asgsgac(Ahd)UfuGfCfUfgugcuuuggaL96 | A-1069740.1 | 747 | VPusCfscaaAfgCfAfcagcAfaUfguccusgsa | UCAGGACAUUGCUGUGCUUUGGG | 4453 |
| AD-953301.1 | A-1701183.1 | 618 | gsgsgca(Ghd)AfaUfCfAfucacgaaguaL96 | A-1067700.1 | 748 | VPusAfscuuCfgUfGfaugaUfuCfugcccsusc | GAGGGCAGAAUCAUCACGAAGUG | 4454 |
| AD-953304.1 | A-1701189.1 | 619 | usgsaag(Uhd)UfcAfUfGfgaugucuauaL96 | A-1067744.1 | 749 | VPusAfsuagAfcAfUfccauGfaAfcuucascsc | GGUGAAGUUCAUGGAUGUCUAUC | 4455 |
| AD-953297.1 | A-1701175.1 | 620 | csgsucg(Chd)AfcUfGfAfaacuuucgaL96 | A-1067242.1 | 750 | VPusCfsgaaAfaGfUfuucaGfuGfcgacgscsc | GGCGUCGCACUGAAACUUUUCGU | 4456 |
| AD-953388.1 | A-1701357.1 | 621 | gsasaaa(Ahd)AfaAfUfCfaguucgaggaL96 | A-1700869.1 | 751 | VPusCfscucGfaAfCfugauUfuUfuuuucsusu | AAGAAAAAAAAUCAGUUCGAGGA | 4457 |
| AD-953407.1 | A-1701395.1 | 622 | asusugg(Uhd)GfuCfUfUfcacuggaugaL96 | A-1069372.1 | 752 | VPusCfsaucCfaGfUfgaagAfcAfccaausasa | UUAUUGGUGUCUUCACUGGAUGU | 4458 |
| AD-953397.1 | A-1701375.1 | 623 | asgsauc(Chd)GfcAfGfAfcguguaaauaL96 | A-1068484.1 | 753 | VPusAfsuuuAfcAfCfgucuGfcGfgaucusg | CAAGAUCCGCAGACGUGUAAAUG | 4459 |
| AD-953398.1 | A-1701377.1 | 624 | gsasucc(Ghd)CfaGfAfCfguguaaaugaL96 | A-1068486.1 | 754 | VPusCfsauuUfaCfAfcgucUfgCfggaucsusu | AAGAUCCGCAGACGUGUAAAUGU | 4460 |
| AD-953396.1 | A-1701373.1 | 625 | ususguu(Uhd)GfuAfCfAfagauccgcaaL96 | A-1068462.1 | 755 | VPusUfsgcgGfaUfCfuuguAfcAfaacaasasu | AUUUGUUUGUACAAGAUCCGCAG | 4461 |
| AD-953356.1 | A-1701293.1 | 626 | usgscug(Uhd)GfgAfCfUfugaguugggaL96 | A-1069428.1 | 756 | VPusCfsccaAfcUfCfaaguCfcAfcagcasgsu | ACUGCUGUGGACUUGAGUUGGGA | 4462 |
| AD-953422.1 | A-1701425.1 | 627 | csascgu(Chd)UfuUfGfUfcucuagugcaL96 | A-1070932.1 | 757 | VPusGfscacUfaGfAfgacaAfaGfacgugsasu | AUCACGUCUUUGUCUCUAGUGCA | 4463 |
| AD-953413.1 | A-1701407.1 | 628 | usususuu(Uhd)UfcAfGfUfauucuugguaL96 | A-1700899.1 | 758 | VPusAfsccaAfgAfAfuacuGfaAfaaaaasasc | GUUUUUUUUCAGUAUUCUUGGUU | 4464 |
| AD-953294.1 | A-1701169.1 | 629 | gsusgcu(Ghd)GfaAfUfUfugauauucaaL96 | A-1066884.1 | 759 | VPusUfsgaaUfaUfCfaaauUfcCfagcacscsg | CGGUGCUGGAAUUUGAUAUUCAU | 4465 |
| AD-953421.1 | A-1701423.1 | 630 | ususaac(Ahd)UfcAfCfGfucuuugucuaL96 | A-1070918.1 | 760 | VPusAfsgacAfaAfGfacguGfaUfguuaasusa | UAUUAACAUCACGUCUUUGUCUC | 4466 |
| AD-953310.1 | A-1701201.1 | 631 | asgsggg(Chd)AfaAfAfAfcgaaagcgcaL96 | A-1700793.1 | 761 | VPusGfscgcUfuUfCfguuuUfuGfccccususu | AAAGGGGCAAAAACGAAAGCGCA | 4467 |

TABLE 3A-continued

| Duplex Name | Sense Oligo Name | SEQ ID NO: (Sense) | Sense Sequence | Anti-sense Oligo Name | SEQ ID NO: (Anti-sense) | Antisense Sequence | mRNA target sequence | SEQ ID NO: (mRNA target) |
|---|---|---|---|---|---|---|---|---|
| Exemplary Human VEGF-A siRNA Modified Single Strands and Duplex Sequences | | | | | | | | |
| AD-953296.1 | A-1701173.1 | 632 | asasagu(Ghd)AfgUfGfAfccugcuuuuaL96 | A-1067146.1 | 762 | VPusAfsaaaGfcAfGfgucaCfuCfacuuusgsc | GCAAAGUGAGUGACCUGCUUUUG | 4468 |
| AD-953402.1 | A-1701385.1 | 633 | asasaaa(Chd)AfcAfGfAfcucgcguugaL96 | A-1068540.1 | 763 | VPusCfsaacGfcGfAfgucuGfuGfuuuuusgsc | GCAAAAACACAGACUCGCGUUGC | 4469 |
| AD-953312.1 | A-1701205.1 | 634 | asusuug(Uhd)UfuGfUfAfcaagauccgaL96 | A-1068458.1 | 764 | VPusCfsggaUfcUfUfguacAfaAfcaaausgsc | GCAUUUGUUUGUACAAGAUCCGC | 4470 |
| AD-953295.1 | A-1701171.1 | 635 | ususccc(Chd)AfaAfUfCfacuguggauaL96 | A-1700778.1 | 765 | VPusAfsuccAfcAfGfugauUfuGfgggaasgsu | ACUUCCCCAAAUCACUGUGGAUU | 4471 |
| AD-953420.1 | A-1701421.1 | 636 | asusuaa(Chd)AfuCfAfCfgucuuugucaL96 | A-1070916.1 | 766 | VPusGfsacaAfaGfAfcgugAfuGfuuaausasu | AUAUUAACAUCACGUCUUUGUCU | 4472 |
| AD-953423.1 | A-1701427.1 | 637 | csgsucu(Uhd)UfgUfCfUfcuagugcagaL96 | A-1070936.1 | 767 | VPusCfsugcAfcUfAfgagaCfaAfagacgsusg | CACGUCUUUGUCUCUAGUGCAGU | 4473 |
| AD-953403.1 | A-1701387.1 | 638 | asasaac(Ahd)CfaGfAfCfucgcguugcaL96 | A-1068542.1 | 768 | VPusGfscaaCfgCfGfagucUfgUfguuuusus g | CAAAAACACAGACUCGCGUUGCA | 4474 |
| AD-953400.1 | A-1701381.1 | 639 | usgscaa(Ahd)AfaCfAfCfagacucgcgaL96 | A-1068534.1 | 769 | VPusCfsgcgAfgUfCfugugUfuUfuugcasgsg | CCUGCAAAAACACAGACUCGCGU | 4475 |
| AD-953404.1 | A-1701389.1 | 640 | asascac(Ahd)GfaCfUfCfgcguugcaaaL96 | A-1068546.1 | 770 | VPusUfsugcAfaCfGfcgagUfcUfguguusus u | AAAACACAGACUCGCGUUGCAAG | 4476 |
| AD-953334.1 | A-1701249.1 | 641 | csusugc(Ahd)GfaUfGfUfgacaagccgaL96 | A-1068644.1 | 771 | VPusCfsggcUfuGfUfcacaUfcUfgcaagsusa | UACUUGCAGAUGUGACAAGCCGA | 4477 |
| AD-953418.1 | A-1701417.1 | 642 | ususuau(Chd)CfgUfAfAfuaauuguggaL96 | A-1070894.1 | 772 | VPusCfscacAfaUfUfauuaCfgGfauaaascsa | UGUUUAUCCGUAAUAAUUGUGGG | 4478 |
| AD-953401.1 | A-1701383.1 | 643 | gscsaaa(Ahd)AfcAfCfAfgacucgcguaL96 | A-1068536.1 | 773 | VPusAfscgcGfaGfUfcuguGfuUfuuugcsasg | CUGCAAAAACACAGACUCGCGUU | 4479 |
| AD-953417.1 | A-1701415.1 | 644 | gsusuua(Uhd)CfcGfUfAfauaauugugaL96 | A-1070892.1 | 774 | VPusCfsacaAfuUfAfuuacGfgAfuaaacsasg | CUGUUUAUCCGUAAUAAUUGUGG | 4480 |
| AD-953311.1 | A-1701203.1 | 645 | gsgsgca(Ahd)AfaAfCfGfaaagcgcaaaL96 | A-1068252.1 | 775 | VPusUfsugcGfcUfUfucguUfuUfugcccscsu | AGGGGCAAAAACGAAAGCGCAAG | 4481 |
| AD-953419.1 | A-1701419.1 | 646 | ususauc(Chd)GfuAfAfUfaauugugggaL96 | A-1700905.1 | 776 | VPusCfsccaCfaAfUfuauuAfcGfgauaaasasc | GUUUAUCCGUAAUAAUUGUGGGG | 4482 |

TABLE 3B

Exemplary Human VEGF-A siRNA Unmodified Single Strandsand Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-953340.1 | A-1701261.1 | 777 | ACUGAUACAGAACGAUCGAUA | 1799-1819 | A-1068804.1 | 907 | UAUCGAUCGUUCUGUAUCAGUCU | 1797-1819 |
| AD-953336.1 | A-1701253.1 | 778 | AAAGACUGAUACAGAACGAUA | 1795-1815 | A-1068796.1 | 908 | UAUCGUUCUGUAUCAGUCUUUCC | 1793-1815 |
| AD-953363.1 | A-1701307.1 | 779 | GAGAAAGUGUUUUAUAUACGA | 2944-2964 | A-1070290.1 | 909 | UCGUAUAUAAAACACUUUCUCUU | 2942-2964 |
| AD-953338.1 | A-1701257.1 | 780 | AGACUGAUACAGAACGAUCGA | 1797-1817 | A-1068800.1 | 910 | UCGAUCGUUCUGUAUCAGUCUUU | 1795-1817 |
| AD-953367.1 | A-1701315.1 | 781 | CAACUAUUUAUGAGAUGUAUA | 3061-3081 | A-1070376.1 | 911 | UAUACAUCUCAUAAAUAGUUGAA | 3059-3081 |
| AD-953337.1 | A-1701255.1 | 782 | AAGACUGAUACAGAACGAUCA | 1796-1816 | A-1068798.1 | 912 | UGAUCGUUCUGUAUCAGUCUUUC | 1794-1816 |
| AD-953342.1 | A-1701265.1 | 783 | AUACAGAACGAUCGAUACAGA | 1803-1823 | A-1068812.1 | 913 | UCUGUAUCGAUCGUUCUGUAUCA | 1801-1823 |
| AD-953350.1 | A-1701281.1 | 784 | AACAGUGCUAAUGUUAUUGGA | 2178-2198 | A-1069342.1 | 914 | UCCAAUAACAUUAGCACUGUUAA | 2176-2198 |
| AD-953352.1 | A-1701285.1 | 785 | GUGCUAAUGUUAUUGGUGUCA | 2182-2202 | A-1069350.1 | 915 | UGACACCAAUAACAUUAGCACUG | 2180-2202 |
| AD-953368.1 | A-1701317.1 | 786 | AACUAUUUAUGAGAUGUAUCA | 3062-3082 | A-1070378.1 | 916 | UGAUACAUCUCAUAAAUAGUUGA | 3060-3082 |
| AD-953344.1 | A-1701269.1 | 787 | CAGAACAGUCCUUAAUCCAGA | 1858-1878 | A-1068918.1 | 917 | UCUGGAUUAAGGACUGUUCUGUC | 1856-1878 |
| AD-953339.1 | A-1701259.1 | 788 | GACUGAUACAGAACGAUCGAA | 1798-1818 | A-1068802.1 | 918 | UUCGAUCGUUCUGUAUCAGUCUU | 1796-1818 |
| AD-953387.1 | A-1701355.1 | 789 | ACAGCACAACAAAUGUGAAUA | 1407-1427 | A-1068170.1 | 919 | UAUUCACAUUUGUUGUGCUGUAG | 1405-1427 |
| AD-953375.1 | A-1701331.1 | 790 | AAAUAGACAUUGCUAUUCUGA | 3362-3382 | A-1070792.1 | 920 | UCAGAAUAGCAAUGUCUAUUUUA | 3360-3382 |
| AD-953355.1 | A-1701291.1 | 791 | UAUUGGUGUCUUCACUGGAUA | 2192-2212 | A-1069370.1 | 921 | UAUCCAGUGAAGACACCAAUAAC | 2190-2212 |
| AD-953341.1 | A-1701263.1 | 792 | CUGAUACAGAACGAUCGAUAA | 1800-1820 | A-1068806.1 | 922 | UUAUCGAUCGUUCUGUAUCAGUC | 1798-1820 |
| AD-953370.1 | A-1701321.1 | 793 | GCUCUCUUAUUUGUACCGGUA | 3096-3116 | A-1070446.1 | 923 | UACCGGUACAAAUAAGAGAGCAA | 3094-3116 |
| AD-953362.1 | A-1701305.1 | 794 | CACCAUUGAAACCACUAGUUA | 2791-2811 | A-1070096.1 | 924 | UAACUAGUGGUUUCAAUGGUGUG | 2789-2811 |

TABLE 3B-continued

Exemplary Human VEGF-A siRNA Unmodified Single Strandsand Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-953322.1 | A-1701225.1 | 795 | GGCAGCUUGAGUUAAACGAAA | 1685-1705 | A-1068596.1 | 925 | UUUCGUUUAACUCAAGCUGCCUC | 1683-1705 |
| AD-953332.1 | A-1701245.1 | 796 | UUAAACGAACGUACUUGCAGA | 1696-1716 | A-1068618.1 | 926 | UCUGCAAGUACGUUCGUUUAACU | 1694-1716 |
| AD-953371.1 | A-1701323.1 | 797 | UCGGUGACAGUCACUAGCUUA | 3158-3178 | A-1070550.1 | 927 | UAAGCUAGUGACUGUCACCGAUC | 3156-3178 |
| AD-953331.1 | A-1701243.1 | 798 | AGUUAAACGAACGUACUUGCA | 1694-1714 | A-1068614.1 | 928 | UGCAAGUACGUUCGUUUAACUCA | 1692-1714 |
| AD-953323.1 | A-1701227.1 | 799 | GCAGCUUGAGUUAAACGAACA | 1686-1706 | A-1068598.1 | 929 | UGUUCGUUUAACUCAAGCUGCCU | 1684-1706 |
| AD-953351.1 | A-1701283.1 | 800 | AGUGCUAAUGUUAUUGGUGUA | 2181-2201 | A-1069348.1 | 930 | UACACCAAUAACAUUAGCACUGU | 2179-2201 |
| AD-953386.1 | A-1701353.1 | 801 | CGAAGUGGUGAAGUUCAUGGA | 1152-1172 | A-1067728.1 | 931 | UCCAUGAACUUCACCACUUCGUG | 1150-1172 |
| AD-953394.1 | A-1701369.1 | 802 | AAAGCAUUUGUUUGUACAAGA | 1611-1631 | A-1068448.1 | 932 | UCUUGUACAAACAAAUGCUUUCU | 1609-1631 |
| AD-953359.1 | A-1701299.1 | 803 | AUGUCCUCACACCAUUGAAAA | 2782-2802 | A-1070078.1 | 933 | UUUUCAAUGGUGUGAGGACAUAG | 2780-2802 |
| AD-953329.1 | A-1701239.1 | 804 | UGAGUUAAACGAACGUACUUA | 1692-1712 | A-1068610.1 | 934 | UAAGUACGUUCGUUUAACUCAAG | 1690-1712 |
| AD-953361.1 | A-1701303.1 | 805 | ACACCAUUGAAACCACUAGUA | 2790-2810 | A-1070094.1 | 935 | UACUAGUGGUUUCAAUGGUGUGA | 2788-2810 |
| AD-953319.1 | A-1701219.1 | 806 | CAAAAACACAGACUCGCGUUA | 1656-1676 | A-1068538.1 | 936 | UAACGCGAGUCUGUGUUUUUGCA | 1654-1676 |
| AD-953360.1 | A-1701301.1 | 807 | UGUCCUCACACCAUUGAAACA | 2783-2803 | A-1070080.1 | 937 | UGUUUCAAUGGUGUGAGGACAUA | 2781-2803 |
| AD-953324.1 | A-1701229.1 | 808 | CAGCUUGAGUUAAACGAACGA | 1687-1707 | A-1068600.1 | 938 | UCGUUCGUUUAACUCAAGCUGCC | 1685-1707 |
| AD-953378.1 | A-1701337.1 | 809 | GGUGCUACUGUUUAUCCGUAA | 3480-3500 | A-1070874.1 | 939 | UUACGGAUAAACAGUAGCACCAA | 3478-3500 |
| AD-953369.1 | A-1701319.1 | 810 | UUGCUCUCUUAUUUGUACCGA | 3094-3114 | A-1070442.1 | 940 | UCGGUACAAAUAAGAGAGCAAGA | 3092-3114 |
| AD-953347.1 | A-1701275.1 | 811 | UCUUGCUGCUAAAUCACCGAA | 2010-2030 | A-1069188.1 | 941 | UUCGGUGAUUUAGCAGCAAGAAA | 2008-2030 |
| AD-953365.1 | A-1701311.1 | 812 | CGGUACUUAUUUAAUAUCCCA | 2962-2982 | A-1070326.1 | 942 | UGGGAUAUUAAAUAAGUACCGUA | 2960-2982 |

TABLE 3B-continued

Exemplary Human VEGF-A siRNA Unmodified Single Strandsand Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-953374.1 | A-1701329.1 | 813 | AAAAUAGACAUUGCUAUUCUA | 3361-3381 | A-1070790.1 | 943 | UAGAAUAGCAAUGUCUAUUUUAU | 3359-3381 |
| AD-953384.1 | A-1701349.1 | 814 | ACUUUUCGUCCAACUUCUGGA | 657-677 | A-1067266.1 | 944 | UCCAGAAGUUGGACGAAAAGUUU | 655-677 |
| AD-953376.1 | A-1701333.1 | 815 | UUGGUGCUACUGUUUAUCCGA | 3478-3498 | A-1070870.1 | 945 | UCGGAUAAACAGUAGCACCAAUA | 3476-3498 |
| AD-953354.1 | A-1701289.1 | 816 | GUUAUUGGUGUCUUCACUGGA | 2190-2210 | A-1069366.1 | 946 | UCCAGUGAAGACACCAAUAACAU | 2188-2210 |
| AD-953385.1 | A-1701351.1 | 817 | UUCGUCCAACUUCUGGGCUGA | 661-681 | A-1067274.1 | 947 | UCAGCCCAGAAGUUGGACGAAAA | 659-681 |
| AD-953346.1 | A-1701273.1 | 818 | UUCUUGCUGCUAAAUCACCGA | 2009-2029 | A-1069186.1 | 948 | UCGGUGAUUUAGCAGCAAGAAAA | 2007-2029 |
| AD-953366.1 | A-1701313.1 | 819 | GGUACUUAUUUAAUAUCCCUA | 2963-2983 | A-1070328.1 | 949 | UAGGGAUAUUAAAUAAGUACCGU | 2961-2983 |
| AD-953382.1 | A-1701345.1 | 820 | AUAUUAACAUCACGUCUUUGA | 3517-3537 | A-1070912.1 | 950 | UCAAAGACGUGAUGUUAAUAUCU | 3515-3537 |
| AD-953320.1 | A-1701221.1 | 821 | GAGGCAGCUUGAGUUAAACGA | 1683-1703 | A-1068592.1 | 951 | UCGUUUAACUCAAGCUGCCUCGC | 1681-1703 |
| AD-953379.1 | A-1701339.1 | 822 | GUGCUACUGUUUAUCCGUAAA | 3481-3501 | A-1070876.1 | 952 | UUUACGGAUAAACAGUAGCACCA | 3479-3501 |
| AD-953321.1 | A-1701223.1 | 823 | AGGCAGCUUGAGUUAAACGAA | 1684-1704 | A-1068594.1 | 953 | UUCGUUUAACUCAAGCUGCCUCG | 1682-1704 |
| AD-953377.1 | A-1701335.1 | 824 | UGGUGCUACUGUUUAUCCGUA | 3479-3499 | A-1070872.1 | 954 | UACGGAUAAACAGUAGCACCAAU | 3477-3499 |
| AD-953392.1 | A-1701365.1 | 825 | AAGGGGCAAAAACGAAAGCGA | 1483-1503 | A-1700876.1 | 955 | UCGCUUUCGUUUUUGCCCCUUUC | 1481-1503 |
| AD-953373.1 | A-1701327.1 | 826 | ACAGUCACUAGCUUAUCUUGA | 3164-3184 | A-1070562.1 | 956 | UCAAGAUAAGCUAGUGACUGUCA | 3162-3184 |
| AD-953364.1 | A-1701309.1 | 827 | ACGGUACUUAUUUAAUAUCCA | 2961-2981 | A-1070324.1 | 957 | UGGAUAUUAAAUAAGUACCGUAU | 2959-2981 |
| AD-953330.1 | A-1701241.1 | 828 | GAGUUAAACGAACGUACUUGA | 1693-1713 | A-1068612.1 | 958 | UCAAGUACGUUCGUUUAACUCAA | 1691-1713 |
| AD-953353.1 | A-1701287.1 | 829 | UGUUAUUGGUGUCUUCACUGA | 2189-2209 | A-1069364.1 | 959 | UCAGUGAAGACACCAAUAACAUU | 2187-2209 |
| AD-953343.1 | A-1701267.1 | 830 | CGACAGAACAGUCCUUAAUCA | 1855-1875 | A-1068912.1 | 960 | UGAUUAAGGACUGUUCUGUCGAU | 1853-1875 |

TABLE 3B-continued

Exemplary Human VEGF-A siRNA Unmodified Single Strandsand Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-953390.1 | A-1701361.1 | 831 | AAAAUCAGUUCGAGGAAAGGA | 1461-1481 | A-1700873.1 | 961 | UCCUUUCCUCGAACUGAUUUUUU | 1459-1481 |
| AD-953345.1 | A-1701271.1 | 832 | CUUGGAAUUGGAUUCGCCAUA | 1982-2002 | A-1069132.1 | 962 | UAUGGCGAAUCCAAUUCCAAGAG | 1980-2002 |
| AD-953358.1 | A-1701297.1 | 833 | AGAGAAGAGACACAUUGUUGA | 2673-2693 | A-1069954.1 | 963 | UCAACAAUGUGUCUCUUCUCUUC | 2671-2693 |
| AD-953383.1 | A-1701347.1 | 834 | ACGUCUUUGUCUCUAGUGCAA | 3528-3548 | A-1070934.1 | 964 | UUGCACUAGAGACAAAGACGUGA | 3526-3548 |
| AD-953372.1 | A-1701325.1 | 835 | UGACAGUCACUAGCUUAUCUA | 3162-3182 | A-1070558.1 | 965 | UAGAUAAGCUAGUGACUGUCACC | 3160-3182 |
| AD-953328.1 | A-1701237.1 | 836 | UUGAGUUAAACGAACGUACUA | 1691-1711 | A-1068608.1 | 966 | UAGUACGUUCGUUUAACUCAAGC | 1689-1711 |
| AD-953393.1 | A-1701367.1 | 837 | GAAAGCAUUUGUUUGUACAAA | 1610-1630 | A-1068446.1 | 967 | UUUGUACAAACAAAUGCUUUCUC | 1608-1630 |
| AD-953307.1 | A-1701195.1 | 838 | AUCACCAUGCAGAUUAUGCGA | 1342-1362 | A-1068040.1 | 968 | UCGCAUAAUCUGCAUGGUGAUGU | 1340-1362 |
| AD-953308.1 | A-1701197.1 | 839 | CACCAUGCAGAUUAUGCGGAA | 1344-1364 | A-1068044.1 | 969 | UUCCGCAUAAUCUGCAUGGUGAU | 1342-1364 |
| AD-953327.1 | A-1701235.1 | 840 | CUUGAGUUAAACGAACGUACA | 1690-1710 | A-1068606.1 | 970 | UGUACGUUCGUUUAACUCAAGCU | 1688-1710 |
| AD-953335.1 | A-1701251.1 | 841 | UUGCAGAUGUGACAAGCCGAA | 1710-1730 | A-1068646.1 | 971 | UUCGGCUUGUCACAUCUGCAAGU | 1708-1730 |
| AD-953414.1 | A-1701409.1 | 842 | ACUAUUUAUGAGAUGUAUCUA | 3063-3083 | A-1070380.1 | 972 | UAGAUACAUCUCAUAAAUAGUUG | 3061-3083 |
| AD-953412.1 | A-1701405.1 | 843 | UUUUUUUUCAGUAUUCUUGGA | 3027-3047 | A-1700897.1 | 973 | UCCAAGAAUACUGAAAAAAAACC | 3025-3047 |
| AD-953411.1 | A-1701403.1 | 844 | GUUUUAUAUACGGUACUUAUA | 2952-2972 | A-1070306.1 | 974 | UAUAAGUACCGUAUAUAAAACAC | 2950-2972 |
| AD-953410.1 | A-1701401.1 | 845 | GAAAGUGUUUUAUAUACGGUA | 2946-2966 | A-1070294.1 | 975 | UACCGUAUAUAAAACACUUUCUC | 2944-2966 |
| AD-953408.1 | A-1701397.1 | 846 | UCACUGGAUGUAUUUGACUGA | 2203-2223 | A-1069392.1 | 976 | UCAGUCAAAUACAUCCAGUGAAG | 2201-2223 |
| AD-953326.1 | A-1701233.1 | 847 | GCUUGAGUUAAACGAACGUAA | 1689-1709 | A-1068604.1 | 977 | UUACGUUCGUUUAACUCAAGCUG | 1687-1709 |
| AD-953300.1 | A-1701181.1 | 848 | CCUCCGAAACCAUGAACUUUA | 1028-1048 | A-1067482.1 | 978 | UAAAGUUCAUGGUUUCGGAGGCC | 1026-1048 |

TABLE 3B-continued

Exemplary Human VEGF-A siRNA Unmodified Single Strandsand Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-953389.1 | A-1701359.1 | 849 | AAAAAUCAGUUCGAGGAAAGA | 1460-1480 | A-1700871.1 | 979 | UCUUUCCUCGAACUGAUUUUUUU | 1458-1480 |
| AD-953415.1 | A-1701411.1 | 850 | GAGAAUUCUACAUACUAAAUA | 3416-3436 | A-1070816.1 | 980 | UAUUUAGUAUGUAGAAUUCUCUA | 3414-3436 |
| AD-953309.1 | A-1701199.1 | 851 | AGAUUAUGCGGAUCAAACCUA | 1352-1372 | A-1068060.1 | 981 | UAGGUUUGAUCCGCAUAAUCUGC | 1350-1372 |
| AD-953391.1 | A-1701363.1 | 852 | AAAUCAGUUCGAGGAAAGGGA | 1462-1482 | A-1068240.1 | 982 | UCCCUUUCCUCGAACUGAUUUUU | 1460-1482 |
| AD-953395.1 | A-1701371.1 | 853 | GCAUUUGUUUGUACAAGAUCA | 1614-1634 | A-1068454.1 | 983 | UGAUCUUGUACAAACAAAUGCUU | 1612-1634 |
| AD-953303.1 | A-1701187.1 | 854 | CACGAAGUGGUGAAGUUCAUA | 1150-1170 | A-1067724.1 | 984 | UAUGAACUUCACCACUUCGUGAU | 1148-1170 |
| AD-953405.1 | A-1701391.1 | 855 | UAAUCCAGAAACCUGAAAUGA | 1870-1890 | A-1068942.1 | 985 | UCAUUUCAGGUUUCUGGAUUAAG | 1868-1890 |
| AD-953305.1 | A-1701191.1 | 856 | CAUCUUCAAGCCAUCCUGUGA | 1251-1271 | A-1067926.1 | 986 | UCACAGGAUGGCUUGAAGAUGUA | 1249-1271 |
| AD-953380.1 | A-1701341.1 | 857 | UGCUACUGUUUAUCCGUAAUA | 3482-3502 | A-1070878.1 | 987 | UAUUACGGAUAAACAGUAGCACC | 3480-3502 |
| AD-953349.1 | A-1701279.1 | 858 | UUGCUGCUAAAUCACCGAGCA | 2012-2032 | A-1069192.1 | 988 | UGCUCGGUGAUUUAGCAGCAAGA | 2010-2032 |
| AD-953381.1 | A-1701343.1 | 859 | GAUAUUAACAUCACGUCUUUA | 3516-3536 | A-1070910.1 | 989 | UAAAGACGUGAUGUUAAUAUCUU | 3514-3536 |
| AD-953318.1 | A-1701217.1 | 860 | CUGCAAAAACACAGACUCGCA | 1653-1673 | A-1068532.1 | 990 | UGCGAGUCUGUGUUUUUGCAGGA | 1651-1673 |
| AD-953348.1 | A-1701277.1 | 861 | CUUGCUGCUAAAUCACCGAGA | 2011-2031 | A-1069190.1 | 991 | UCUCGGUGAUUUAGCAGCAAGAA | 2009-2031 |
| AD-953409.1 | A-1701399.1 | 862 | AGAAAGUGUUUUAUAUACGGA | 2945-2965 | A-1070292.1 | 992 | UCCGUAUAUAAAACACUUUCUCU | 2943-2965 |
| AD-953306.1 | A-1701193.1 | 863 | AACAUCACCAUGCAGAUUAUA | 1339-1359 | A-1068034.1 | 993 | UAUAAUCUGCAUGGUGAUGUUGG | 1337-1359 |
| AD-953316.1 | A-1701213.1 | 864 | CGCAGACGUGUAAAUGUUCCA | 1634-1654 | A-1068494.1 | 994 | UGGAACAUUUACACGUCUGCGGA | 1632-1654 |
| AD-953325.1 | A-1701231.1 | 865 | AGCUUGAGUUAAACGAACGUA | 1688-1708 | A-1068602.1 | 995 | UACGUUCGUUUAACUCAAGCUGC | 1686-1708 |
| AD-953299.1 | A-1701179.1 | 866 | GCACUGAAACUUUUCGUCCAA | 649-669 | A-1067250.1 | 996 | UUGGACGAAAAGUUUCAGUGCGA | 647-669 |

TABLE 3B-continued

Exemplary Human VEGF-A siRNA Unmodified Single Strandsand Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-953416.1 | A-1701413.1 | 867 | AAUUCUACAUACUAAAUCUCA | 3419-3439 | A-1070822.1 | 997 | UGAGAUUUAGUAUGUAGAAUUCU | 3417-3439 |
| AD-953315.1 | A-1701211.1 | 868 | CCGCAGACGUGUAAAUGUUCA | 1633-1653 | A-1068492.1 | 998 | UGAACAUUUACACGUCUGCGGAU | 1631-1653 |
| AD-953314.1 | A-1701209.1 | 869 | UCCGCAGACGUGUAAAUGUUA | 1632-1652 | A-1068490.1 | 999 | UAACAUUUACACGUCUGCGGAUC | 1630-1652 |
| AD-953298.1 | A-1701177.1 | 870 | CGCACUGAAACUUUUCGUCCA | 648-668 | A-1067248.1 | 1000 | UGGACGAAAAGUUUCAGUGCGAC | 646-668 |
| AD-953406.1 | A-1701393.1 | 871 | CCCUCUUGGAAUUGGAUUCGA | 1978-1998 | A-1069124.1 | 1001 | UCGAAUCCAAUUCCAAGAGGGAC | 1976-1998 |
| AD-953399.1 | A-1701379.1 | 872 | CAGACGUGUAAAUGUUCCUGA | 1636-1656 | A-1068498.1 | 1002 | UCAGGAACAUUUACACGUCUGCG | 1634-1656 |
| AD-953333.1 | A-1701247.1 | 873 | ACGAACGUACUUGCAGAUGUA | 1700-1720 | A-1068626.1 | 1003 | UACAUCUGCAAGUACGUUCGUUU | 1698-1720 |
| AD-953313.1 | A-1701207.1 | 874 | AUCCGCAGACGUGUAAAUGUA | 1631-1651 | A-1068488.1 | 1004 | UACAUUUACACGUCUGCGGAUCU | 1629-1651 |
| AD-953302.1 | A-1701185.1 | 875 | CAGAAUCAUCACGAAGUGGUA | 1141-1161 | A-1067706.1 | 1005 | UACCACUUCGUGAUGAUUCUGCC | 1139-1161 |
| AD-953317.1 | A-1701215.1 | 876 | CCUGCAAAAACACAGACUCGA | 1652-1672 | A-1068530.1 | 1006 | UCGAGUCUGUGUUUUUGCAGGAA | 1650-1672 |
| AD-953357.1 | A-1701295.1 | 877 | AGGACAUUGCUGUGCUUUGGA | 2518-2538 | A-1069740.1 | 1007 | UCCAAAGCACAGCAAUGUCCUGA | 2516-2538 |
| AD-953301.1 | A-1701183.1 | 878 | GGGCAGAAUCAUCACGAAGUA | 1138-1158 | A-1067700.1 | 1008 | UACUUCGUGAUGAUUCUGCCCUC | 1136-1158 |
| AD-953304.1 | A-1701189.1 | 879 | UGAAGUUCAUGGAUGUCUAUA | 1160-1180 | A-1067744.1 | 1009 | UAUAGACAUCCAUGAACUUCACC | 1158-1180 |
| AD-953297.1 | A-1701175.1 | 880 | CGUCGCACUGAAACUUUUCGA | 645-665 | A-1067242.1 | 1010 | UCGAAAAGUUUCAGUGCGACGCC | 643-665 |
| AD-953388.1 | A-1701357.1 | 881 | GAAAAAAAAUCAGUUCGAGGA | 1456-1476 | A-1700869.1 | 1011 | UCCUCGAACUGAUUUUUUUUCUU | 1454-1476 |
| AD-953407.1 | A-1701395.1 | 882 | AUUGGUGUCUUCACUGGAUGA | 2193-2213 | A-1069372.1 | 1012 | UCAUCCAGUGAAGACACCAAUAA | 2191-2213 |
| AD-953397.1 | A-1701375.1 | 883 | AGAUCCGCAGACGUGUAAAUA | 1629-1649 | A-1068484.1 | 1013 | UAUUUACACGUCUGCGGAUCUUG | 1627-1649 |
| AD-953398.1 | A-1701377.1 | 884 | GAUCCGCAGACGUGUAAAUGA | 1630-1650 | A-1068486.1 | 1014 | UCAUUUACACGUCUGCGGAUCUU | 1628-1650 |

TABLE 3B-continued

Exemplary Human VEGF-A siRNA Unmodified Single Strandsand Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-953396.1 | A-1701373.1 | 885 | UUGUUUGUACAAGAUCCGCAA | 1618-1638 | A-1068462.1 | 1015 | UUGCGGAUCUUGUACAAACAAAU | 1616-1638 |
| AD-953356.1 | A-1701293.1 | 886 | UGCUGUGGACUUGAGUUGGGA | 2221-2241 | A-1069428.1 | 1016 | UCCCAACUCAAGUCCACAGCAGU | 2219-2241 |
| AD-953422.1 | A-1701425.1 | 887 | CACGUCUUUGUCUCUAGUGCA | 3527-3547 | A-1070932.1 | 1017 | UGCACUAGAGACAAAGACGUGAU | 3525-3547 |
| AD-953413.1 | A-1701407.1 | 888 | UUUUUUUCAGUAUUCUUGGUA | 3028-3048 | A-1700899.1 | 1018 | UACCAAGAAUACUGAAAAAAAAC | 3026-3048 |
| AD-953294.1 | A-1701169.1 | 889 | GUGCUGGAAUUUGAUAUUCAA | 125-145 | A-1066884.1 | 1019 | UUGAAUAUCAAAUUCCAGCACCG | 123-145 |
| AD-953421.1 | A-1701423.1 | 890 | UUAACAUCACGUCUUUGUCUA | 3520-3540 | A-1070918.1 | 1020 | UAGACAAAGACGUGAUGUUAAUA | 3518-3540 |
| AD-953310.1 | A-1701201.1 | 891 | AGGGGCAAAAACGAAAGCGCA | 1484-1504 | A-1700793.1 | 1021 | UGCGCUUUCGUUUUUGCCCCUUU | 1482-1504 |
| AD-953296.1 | A-1701173.1 | 892 | AAAGUGAGUGACCUGCUUUUA | 415-435 | A-1067146.1 | 1022 | UAAAAGCAGGUCACUCACUUUGC | 413-435 |
| AD-953402.1 | A-1701385.1 | 893 | AAAAACACAGACUCGCGUUGA | 1657-1677 | A-1068540.1 | 1023 | UCAACGCGAGUCUGUGUUUUUGC | 1655-1677 |
| AD-953312.1 | A-1701205.1 | 894 | AUUUGUUUGUACAAGAUCCGA | 1616-1636 | A-1068458.1 | 1024 | UCGGAUCUUGUACAAACAAAUGC | 1614-1636 |
| AD-953295.1 | A-1701171.1 | 895 | UUCCCCAAAUCACUGUGGAUA | 278-298 | A-1700778.1 | 1025 | UAUCCACAGUGAUUUGGGGAAGU | 276-298 |
| AD-953420.1 | A-1701421.1 | 896 | AUUAACAUCACGUCUUUGUCA | 3519-3539 | A-1070916.1 | 1026 | UGACAAAGACGUGAUGUUAAUAU | 3517-3539 |
| AD-953423.1 | A-1701427.1 | 897 | CGUCUUUGUCUCUAGUGCAGA | 3529-3549 | A-1070936.1 | 1027 | UCUGCACUAGAGACAAAGACGUG | 3527-3549 |
| AD-953403.1 | A-1701387.1 | 898 | AAAACACAGACUCGCGUUGCA | 1658-1678 | A-1068542.1 | 1028 | UGCAACGCGAGUCUGUGUUUUUG | 1656-1678 |
| AD-953400.1 | A-1701381.1 | 899 | UGCAAAAACACAGACUCGCGA | 1654-1674 | A-1068534.1 | 1029 | UCGCGAGUCUGUGUUUUUGCAGG | 1652-1674 |
| AD-953404.1 | A-1701389.1 | 900 | AACACAGACUCGCGUUGCAAA | 1660-1680 | A-1068546.1 | 1030 | UUUGCAACGCGAGUCUGUGUUUU | 1658-1680 |
| AD-953334.1 | A-1701249.1 | 901 | CUUGCAGAUGUGACAAGCCGA | 1709-1729 | A-1068644.1 | 1031 | UCGGCUUGUCACAUCUGCAAGUA | 1707-1729 |
| AD-953418.1 | A-1701417.1 | 902 | UUUAUCCGUAAUAAUUGUGGA | 3490-3510 | A-1070894.1 | 1032 | UCCACAAUUAUUACGGAUAAACA | 3488-3510 |

TABLE 3B-continued

| Exemplary Human VEGF-A siRNA Unmodified Single Strandsand Duplex Sequences | | | | | | | | | |
|---|---|---|---|---|---|---|---|---|---|
| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
| AD-953401.1 | A-1701383.1 | 903 | GCAAAAACACAGACUCGCGUA | 1655-1675 | A-1068536.1 | 1033 | UACGCGAGUCUGUGUUUUUGCAG | 1653-1675 |
| AD-953417.1 | A-1701415.1 | 904 | GUUUAUCCGUAAUAAUUGUGA | 3489-3509 | A-1070892.1 | 1034 | UCACAAUUAUUACGGAUAAACAG | 3487-3509 |
| AD-953311.1 | A-1701203.1 | 905 | GGGCAAAAACGAAAGCGCAAA | 1486-1506 | A-1068252.1 | 1035 | UUUGCGCUUUCGUUUUUGCCCCU | 1484-1506 |
| AD-953419.1 | A-1701419.1 | 906 | UUAUCCGUAAUAAUUGUGGGA | 3491-3511 | A-1700905.1 | 1036 | UCCCACAAUUAUUACGGAUAAAC | 3489-3511 |

TABLE 4A

| Exemplary Human VEGF-A siRNA Modified Single Strandsand Duplex Sequences | | | | | | | | |
|---|---|---|---|---|---|---|---|---|
| Duplex Name | Sense Oligo Name | SEQ ID NO: (Sense) | Sense Sequence | Antisense Oligo Name | SEQ ID NO: (Anti-sense) | Antisense Sequence | mRNA target sequence | SEQ ID NO: (mRNA target) |
| AD-953504.1 | A-1701069.1 | 1037 | asasaau(Ahd)gadCadTugcuauucuaL96 | A-1800407.1 | 1167 | VPusdAsgadAudAgcaadTgdTcdTauuuusasu | AUAAAAUAGACAUUGCUAUUCUG | 4483 |
| AD-953481.1 | A-1701023.1 | 1038 | asgsugc(Uhd)aadTgdTuauuggugu aL96 | A-1800384.1 | 1168 | VPusdAscadCcdAauaadCadTudAgcacusgsu | ACAGUGCUAAUGUUAUUGGUGUC | 4484 |
| AD-953472.1 | A-1701005.1 | 1039 | asusaca(Ghd)aadCgdAucgauacagaL96 | A-1800375.1 | 1169 | VPusdCsugdTadTcgaudCgdTudCuguauscsa | UGAUACAGAACGAUCGAUACAGA | 4485 |
| AD-953517.1 | A-1701095.1 | 1040 | ascsagc(Ahd)cadAcdAaaugugaauaL96 | A-1800420.1 | 1170 | VPusdAsuudCadCauuudGudTgdTgcugusasg | CUACAGCACAACAAAUGUGAAUG | 4486 |
| AD-953471.1 | A-1701003.1 | 1041 | csusgau(Ahd)cadGadAcgaucgauaaL96 | A-1800374.1 | 1171 | VPusdTsaudCgdAucgudTcdTgdTaucagsusc | GACUGAUACAGAACGAUCGAUAC | 4487 |
| AD-953493.1 | A-1701047.1 | 1042 | gsasgaa(Ahd)gudGudTuuauauacgaL96 | A-1800396.1 | 1172 | VPusdCsgudAudAuaaadAcdAcdTuucucsusu | AAGAGAAAGUGUUUUAUAUACGG | 4488 |
| AD-953498.1 | A-1701057.1 | 1043 | asascua(Uhd)uudAudGagauguaucaL96 | A-1800401.1 | 1173 | VPusdGsaudAcdAucucdAudAadAuaguusgsa | UCAACUAUUUAUGAGAUGUAUCU | 4489 |
| AD-953467.1 | A-1700995.1 | 1044 | asasgac(Uhd)gadTadCagaacgaucaL96 | A-1800370.1 | 1174 | VPusdGsaudCgdTucugdTadTcdAgucuususc | GAAAGACUGAUACAGAACGAUCG | 4490 |
| AD-953545.1 | A-1701151.1 | 1045 | gsasgaa(Uhd)ucdTadCauacuaaauaL96 | A-1800448.1 | 1175 | VPusdAsuudTadGuaugdTadGadAuucucsusa | UAGAGAAUUCUACAUACUAAAUC | 4491 |
| AD-953466.1 | A-1700993.1 | 1046 | asasaga(Chd)ugdAudAcagaacgauaL96 | A-1800369.1 | 1176 | VPusdAsucdGudTcugudAudCadGucuuuscsc | GGAAAGACUGAUACAGAACGAUC | 4492 |
| AD-953494.1 | A-1701049.1 | 1047 | ascsggu(Ahd)cudTadTuuaaauaucaL96 | A-1800397.1 | 1177 | VPusdGsgadTadTuaaadTadAgdTaccgusasu | AUACGGUACUUAUUUAAUAUCCC | 4493 |

TABLE 4A-continued

Exemplary Human VEGF-A siRNA Modified Single Strandsand Duplex Sequences

| Duplex Name | Sense Oligo Name | SEQ ID NO: (Sense) | Sense Sequence | Antisense Oligo Name | SEQ ID NO: (Anti-sense) | Antisense Sequence | mRNA target sequence | SEQ ID NO: (mRNA target) |
|---|---|---|---|---|---|---|---|---|
| AD-953470.1 | A-1701001.1 | 1048 | ascsuga(Uhd) acdAgdAacgaucgauaL96 | A-1800373.1 | 1178 | VPusdAsucdGadTcguudCudGudAucaguscSU | AGACUGAUACAGAACGAUCGAUA | 4494 |
| AD-953473.1 | A-1701007.1 | 1049 | csgsaca(Ghd)aadCadGuccuuaaucaL96 | A-1800376.1 | 1179 | VPusdGsaudTadAggacdTgdTudCugucgsaSU | AUCGACAGAACAGUCCUUAAUCC | 4495 |
| AD-953474.1 | A-1701009.1 | 1050 | csasgaa(Chd)agdTcdCuuaauccagaL96 | A-1800377.1 | 1180 | VPusdCsugdGadTuaagdGadCudGuucugsusc | GACAGAACAGUCCUUAAUCCAGA | 4496 |
| AD-953480.1 | A-1701021.1 | 1051 | asascag(Uhd)gcdTadAuguuauuggaL96 | A-1800383.1 | 1181 | VPusdCscadAudAacaudTadGcdAcuguusasa | UUAACAGUGCUAAUGUUAUUGGU | 4497 |
| AD-953503.1 | A-1701067.1 | 1052 | ascsagu(Chd)acdTadGcuuaucuugaL96 | A-1800406.1 | 1182 | VPusdCsaadGadTaagcdTadGudGacuguscsa | UGACAGUCACUAGCUUAUCUUGA | 4498 |
| AD-953478.1 | A-1701017.1 | 1053 | csusugc(Uhd)gcdTadAaucaccgagaL96 | A-1800381.1 | 1183 | VPusdCsucdGgdTgauudTadGcdAgcaagsasa | UUCUUGCUGCUAAAUCACCGAGC | 4499 |
| AD-953540.1 | A-1701141.1 | 1054 | gsasaag(Uhd)gudTudTauauacgguaL96 | A-1800443.1 | 1184 | VPusdAsccdGudAuauadAadAcdAcuuucsusc | GAGAAAGUGUUUUAUAUACGGUA | 4500 |
| AD-953500.1 | A-1701061.1 | 1055 | gscsucu(Chd)uudAudTuguaccgguaL96 | A-1800403.1 | 1185 | VPusdAsccdGgdTacaadAudAadGagagcsasa | UUGCUCUCUUAUUUGUACCGGUU | 4501 |
| AD-953476.1 | A-1701013.1 | 1056 | ususcuu(Ghd)cudGcdTaaaucaccgaL96 | A-1800379.1 | 1186 | VPusdCsggdTgdAuuuadGcdAgdCaagaasasa | UUUUCUUGCUGCUAAAUCACCGA | 4502 |
| AD-953492.1 | A-1701045.1 | 1057 | csascca(Uhd)ugdAadAccacuaguuaL96 | A-1800395.1 | 1187 | VPusdAsacdTadGuggudTudCadAuggugsusg | CACACCAUUGAAACCACUAGUUC | 4503 |
| AD-953495.1 | A-1701051.1 | 1058 | csgsgua(Chd)uudAudTuaauaucccaL96 | A-1800398.1 | 1188 | VPusdGsggdAudAuuaadAudAadGuaccgsusa | UACGGUACUUAUUUAAUAUCCCU | 4504 |
| AD-953497.1 | A-1701055.1 | 1059 | csasacu(Ahd)uudTadTgagauguauaL96 | A-1800400.1 | 1189 | VPusdAsuadCadTCUCadTadAadTaguugsasa | UUCAACUAUUUAUGAGAUGUAUC | 4505 |
| AD-953535.1 | A-1701131.1 | 1060 | usasauc(Chd)agdAadAccugaaaugaL96 | A-1800438.1 | 1190 | VPusdCsaudTudCaggudTudCudGgauuasasg | CUUAAUCCAGAAACCUGAAAUGA | 4506 |
| AD-953505.1 | A-1701071.1 | 1061 | asasaua(Ghd)acdAudTgcuauucugaL96 | A-1800408.1 | 1191 | VPusdCsagdAadTagcadAudGudCuauuusus a | UAAAAUAGACAUUGCUAUUCUGU | 4507 |
| AD-953524.1 | A-1701109.1 | 1062 | asasagc(Ahd)uudTgdTuuguacaagaL96 | A-1800427.1 | 1192 | VPusdCsuudGudAcaaadCadAadTgcuuuscsu | AGAAAGCAUUUGUUUGUACAAGA | 4508 |
| AD-953475.1 | A-1701011.1 | 1063 | csusugg(Ahd)audTgdGauucgccauaL96 | A-1800378.1 | 1193 | VPusdAsugdGcdGaaucdCadAudTccaagsasg | CUCUUGGAAUUGGAUUCGCCAUU | 4509 |
| AD-953491.1 | A-1701043.1 | 1064 | ascsacc(Ahd)uudGadAaccacuaguaL96 | A-1800394.1 | 1194 | VPusdAscudAgdTgguudTcdAadTggugusgsa | UCACACCAUUGAAACCACUAGUU | 4510 |
| AD-953436.1 | A-1700933.1 | 1065 | asascau(Chd)acdCadTgcagauuauaL96 | A-1800339.1 | 1195 | VPusdAsuadAudCugcadTgdGudGauguusgsg | CCAACAUCACCAUGCAGAUUAUG | 4511 |

TABLE 4A-continued

Exemplary Human VEGF-A siRNA Modified Single Strandsand Duplex Sequences

| Duplex Name | Sense Oligo Name | SEQ ID NO: (Sense) | Sense Sequence | Antisense Oligo Name | SEQ ID NO: (Anti-sense) | Antisense Sequence | mRNA target sequence | SEQ ID NO: (mRNA target) |
|---|---|---|---|---|---|---|---|---|
| AD-953502.1 | A-1701065.1 | 1066 | usgsaca(Ghd)ucdAcdTagcuuaucuaL96 | A-1800405.1 | 1196 | VPusdAsgadTadAgcuadGudGadCugucascsc | GGUGACAGUCACUAGCUUAUCUU | 4512 |
| AD-953461.1 | A-1700983.1 | 1067 | asgsuua(Ahd)acdGadAcguacuugcaL96 | A-1800364.1 | 1197 | VPusdGscadAgdTacgudTcdGudTuaacuscsa | UGAGUUAAACGAACGUACUUGCA | 4513 |
| AD-953544.1 | A-1701149.1 | 1068 | ascsuau(Uhd)uadTgdAgauguaucuaL96 | A-1800447.1 | 1198 | VPusdAsgadTadCaucudCadTadAauagususg | CAACUAUUUAUGAGAUGUAUCUU | 4514 |
| AD-953462.1 | A-1700985.1 | 1069 | ususaaa(Chd)gadAcdGuacuugcagaL96 | A-1800365.1 | 1199 | VPusdCsugdCadAguacdGudTcdGuuuaascsu | AGUUAAACGAACGUACUUGCAGA | 4515 |
| AD-953496.1 | A-1701053.1 | 1070 | gsgsuac(Uhd)uadTudTaauaucccuaL96 | A-1800399.1 | 1200 | VPusdAsggdGadTauuadAadTadAguaccsgsu | ACGGUACUUAUUUAAUAUCCCUU | 4516 |
| AD-953516.1 | A-1701093.1 | 1071 | csgsaag(Uhd)ggdTgdAaguucauggaL96 | A-1800419.1 | 1201 | VPusdCscadTgdAacuudCadCcdAcuucgsusg | CACGAAGUGGUGAAGUUCAUGGA | 4517 |
| AD-953483.1 | A-1701027.1 | 1072 | usgsuua(Uhd)ugdGudGucuucacugaL96 | A-1800386.1 | 1202 | VPusdCsagdTgdAagacdAcdCadAuaacasusu | AAUGUUAUUGGUGUCUUCACUGG | 4518 |
| AD-953499.1 | A-1701059.1 | 1073 | ususgcu(Chd)ucdTudAuuuguaccgaL96 | A-1800402.1 | 1203 | VPusdCsggdTadCaaaudAadGadGagcaasgsa | UCUUGCUCUCUUAUUUGUACCGG | 4519 |
| AD-953541.1 | A-1701143.1 | 1074 | gsusuuu(Ahd)uadTadCgguacuuauaL96 | A-1800444.1 | 1204 | VPusdAsuadAgdTaccgdTadTadTaaaacsasc | GUGUUUUAUAUACGGUACUUAUU | 4520 |
| AD-953538.1 | A-1701137.1 | 1075 | uscsacu(Ghd)gadTgdTauuugacugaL96 | A-1800441.1 | 1205 | VPusdCsagdTcdAaauadCadTcdCagugasasg | CUUCACUGGAUGUAUUUGACUGC | 4521 |
| AD-953430.1 | A-1700921.1 | 1076 | cscsucc(Ghd)aadAcdCaugaacuuuaL96 | A-1800333.1 | 1206 | VPusdAsaadGudTcaugdGudTudCggaggscsc | GGCCUCCGAAACCAUGAACUUUC | 4522 |
| AD-953485.1 | A-1701031.1 | 1077 | usasuug(Ghd)ugdTcdTucacuggauaL96 | A-1800388.1 | 1207 | VPusdAsucdCadGugaadGadCadCcaauasasc | GUUAUUGGUGUCUUCACUGGAUG | 4523 |
| AD-953468.1 | A-1700997.1 | 1078 | asgsacu(Ghd)audAcdAgaacgaucgaL96 | A-1800371.1 | 1208 | VPusdCsgadTcdGuucudGudAudCagucusu | AAAGACUGAUACAGAACGAUCGA | 4524 |
| AD-953444.1 | A-1700949.1 | 1079 | uscscgc(Ahd)gadCgdTguaaauguuaL96 | A-1800347.1 | 1209 | VPusdAsacdAudTuacadCgdTcdTgcggasusc | GAUCCGCAGACGUGUAAAUGUUC | 4525 |
| AD-953460.1 | A-1700981.1 | 1080 | gsasguu(Ahd)aadCgdAacguacuugaL96 | A-1800363.1 | 1210 | VPusdCsaadGudAcguudCgdTudTaacucsasa | UUGAGUUAAACGAACGUACUUGC | 4526 |
| AD-953539.1 | A-1701139.1 | 1081 | asgsaaa(Ghd)ugdTudTuauauacggaL96 | A-1800442.1 | 1211 | VPusdCscgdTadTauaadAadCadCuuucuscsu | AGAGAAAGUGUUUUAUAUACGGU | 4527 |
| AD-953484.1 | A-1701029.1 | 1082 | gsusuau(Uhd)ggdTgdTcuucacuggaL96 | A-1800387.1 | 1212 | VPusdCscadGudGaagadCadCcdAauaacsasu | AUGUUAUUGGUGUCUUCACUGGA | 4528 |
| AD-953457.1 | A-1700975.1 | 1083 | csusuga(Ghd)uudAadAcgaacguacaL96 | A-1800360.1 | 1213 | VPusdGsuadCgdTucgudTudAadCucaagscsu | AGCUUGAGUUAAACGAACGUACU | 4529 |

TABLE 4A-continued

| Duplex Name | Sense Oligo Name | SEQ ID NO: (Sense) | Sense Sequence | Antisense Oligo Name | SEQ ID NO: (Antisense) | Antisense Sequence | mRNA target sequence | SEQ ID NO: (mRNA target) |
|---|---|---|---|---|---|---|---|---|
| Exemplary Human VEGF-A siRNA Modified Single Strandsand Duplex Sequences | | | | | | | | |
| AD-953459.1 | A-1700979.1 | 1084 | usgsagu(Uhd)aadAcdGaacguacuuaL96 | A-1800362.1 | 1214 | VPusdAsagdTadCguucdGudTudAacucasasg | CUUGAGUUAAACGAACGUACUUG | 4530 |
| AD-953437.1 | A-1700935.1 | 1085 | asuscac(Chd)audGcdAgauuaugcgaL96 | A-1800340.1 | 1215 | VPusdCsgcdAudAaucudGcdAudGgugausgsu | ACAUCACCAUGCAGAUUAUGCGG | 4531 |
| AD-953458.1 | A-1700977.1 | 1086 | ususgag(Uhd)uadAadCgaacguacuaL96 | A-1800361.1 | 1216 | VPusdAsgudAcdGuucgdTudTadAcucaasgsc | GCUUGAGUUAAACGAACGUACUU | 4532 |
| AD-953453.1 | A-1700967.1 | 1087 | gscsagc(Uhd)ugdAgdTuaaacgaacaL96 | A-1800356.1 | 1217 | VPusdGsuudCgdTuuaadCudCadAgcugcscsu | AGGCAGCUUGAGUUAAACGAACG | 4533 |
| AD-953428.1 | A-1700917.1 | 1088 | csgscac(Uhd)gadAadCuuuucguccaL96 | A-1800331.1 | 1218 | VPusdGsgadCgdAaaagdTudTcdAgugcgsasc | GUCGCACUGAAACUUUUCGUCCA | 4534 |
| AD-953501.1 | A-1701063.1 | 1089 | uscsggu(Ghd)acdAgdTcacuagcuuaL96 | A-1800404.1 | 1219 | VPusdAsagdCudAgugadCudGudCaccgasusc | GAUCGGUGACAGUCACUAGCUUA | 4535 |
| AD-953482.1 | A-1701025.1 | 1090 | gsusgcu(Ahd)audGudTauuggugucaL96 | A-1800385.1 | 1220 | VPusdGsacdAcdCaauadAcdAudTagcacsusg | CAGUGCUAAUGUUAUUGGUGUCU | 4536 |
| AD-953446.1 | A-1700953.1 | 1091 | csgscag(Ahd)cgdTgdTaaauguuccaL96 | A-1800349.1 | 1221 | VPusdGsgadAcdAuuuadCadCgdTcugcgsgsa | UCCGCAGACGUGUAAAUGUUCCU | 4537 |
| AD-953488.1 | A-1701037.1 | 1092 | asgsaga(Ahd)gadGadCacauuguugaL96 | A-1800391.1 | 1222 | VPusdCsaadCadAugugdTcdTcdTucucususc | GAAGAGAAGAGACACAUUGUUGG | 4538 |
| AD-953434.1 | A-1700929.1 | 1093 | usgsaag(Uhd)ucdAudGgaugucuauaL96 | A-1800337.1 | 1223 | VPusdAsuadGadCauccdAudGadAcuucascsc | GGUGAAGUUCAUGGAUGUCUAUC | 4539 |
| AD-953546.1 | A-1701153.1 | 1094 | asasuuc(Uhd)acdAudAcuaaaucucaL96 | A-1800449.1 | 1224 | VPusdGsagdAudTagudAudGudAgaauuscsu | AGAAUUCUACAUACUAAAUCUCU | 4540 |
| AD-953529.1 | A-1701119.1 | 1095 | csasgac(Ghd)ugdTadAauguuccugaL96 | A-1800432.1 | 1225 | VPusdCsagdGadAcauudTadCadCgucugscsg | CGCAGACGUGUAAAUGUUCCUGC | 4541 |
| AD-953433.1 | A-1700927.1 | 1096 | csascga(Ahd)gudGgdTgaaguucauaL96 | A-1800336.1 | 1226 | VPusdAsugdAadCuucadCcdAcdTucgugsasu | AUCACGAAGUGGUGAAGUUCAUG | 4542 |
| AD-953456.1 | A-1700973.1 | 1097 | gscsuug(Ahd)gudTadAacgaacguaaL96 | A-1800359.1 | 1227 | VPusdTsacdGudTcguudTadAcdTcaagcsusg | CAGCUUGAGUUAAACGAACGUAC | 4543 |
| AD-953435.1 | A-1700931.1 | 1098 | csasucu(Uhd)cadAgdCcauccugugaL96 | A-1800338.1 | 1228 | VPusdCsacdAgdGauggdCudTgdAagaugsusa | UACAUCUUCAAGCCAUCCUGUGU | 4544 |
| AD-953438.1 | A-1700937.1 | 1099 | csascca(Uhd)gcdAgdAuuaugcggaaL96 | A-1800341.1 | 1229 | VPusdTsccdGcdAuaaudCudGcdAuggugsasu | AUCACCAUGCAGAUUAUGCGGAU | 4545 |
| AD-953452.1 | A-1700965.1 | 1100 | gsgscag(Chd)uudGadGuuaaacgaaaL96 | A-1800355.1 | 1230 | VPusdTsucdGudTuaacdTcdAadGcugccsusc | GAGGCAGCUUGAGUUAAACGAAC | 4546 |
| AD-953489.1 | A-1701039.1 | 1101 | asusguc(Chd)ucdAcdAccauugaaaaL96 | A-1800392.1 | 1231 | VPusdTsuudCadAuggudGudGadGgacausasg | CUAUGUCCUCACACCAUUGAAAC | 4547 |

TABLE 4A-continued

Exemplary Human VEGF-A siRNA Modified Single Strandsand Duplex Sequences

| Duplex Name | Sense Oligo Name | SEQ ID NO: (Sense) | Sense Sequence | Antisense Oligo Name | SEQ ID NO: (Anti-sense) | Antisense Sequence | mRNA target sequence | SEQ ID NO: (mRNA target) |
|---|---|---|---|---|---|---|---|---|
| AD-953445.1 | A-1700951.1 | 1102 | cscsgca(Ghd)acdGudGuaaauguucaL96 | A-1800348.1 | 1232 | VPusdGsaadCadTuuacdAcdGudCugcggsasu | AUCCGCAGACGUGUAAAUGUUCC | 4548 |
| AD-953432.1 | A-1700925.1 | 1103 | csasgaa(Uhd)cadTcdAcgaagugguaL96 | A-1800335.1 | 1233 | VPusdAscadAcdTucgudGadTgdAuucugscsc | GGCAGAAUCAUCACGAAGUGGUG | 4549 |
| AD-953509.1 | A-1701079.1 | 1104 | gsusgcu(Ahd)cudGudTuauccguaaaL96 | A-1800412.1 | 1234 | VPusdTsuadCgdGauaadAcdAgdTagcacscsa | UGGUGCUACUGUUUAUCCGUAAU | 4550 |
| AD-953490.1 | A-1701041.1 | 1105 | usgsucc(Uhd)cadCadCcauugaaacaL96 | A-1800393.1 | 1235 | VPusdGsuudTcdAauggdTgdTgdAggacasusa | UAUGUCCUCACACCAUUGAAACC | 4551 |
| AD-953448.1 | A-1700957.1 | 1106 | csusgca(Ahd)aadAcdAcagacucgcaL96 | A-1800351.1 | 1236 | VPusdGscgdAgdTcugudGudTudTugcagsgsa | UCCUGCAAAAACACAGACUCGCG | 4552 |
| AD-953450.1 | A-1700961.1 | 1107 | gsasggc(Ahd)gcdTudGaguuaaacgaL96 | A-1800353.1 | 1237 | VPusdCsgudTudAacucdAadGcdTgccucsgsc | GCGAGGCAGCUUGAGUUAAACGA | 4553 |
| AD-953443.1 | A-1700947.1 | 1108 | asusccg(Chd)agdAcdGuguaaauguaL96 | A-1800346.1 | 1238 | VPusdAscadTudTacacdGudCudGcggauscsu | AGAUCCGCAGACGUGUAAAUGUU | 4554 |
| AD-953525.1 | A-1701111.1 | 1109 | gscsauu(Uhd)gudTudGuacaagaucaL96 | A-1800428.1 | 1239 | VPusdGsaudCudTguacdAadAcdAaaugcsusu | AAGCAUUUGUUUGUACAAGAUCC | 4555 |
| AD-953523.1 | A-1701107.1 | 1110 | gsasaag(Chd)audTudGuuuguacaaaL96 | A-1800426.1 | 1240 | VPusdTsugdTadCaaacdAadAudGcuuucsusc | GAGAAAGCAUUUGUUUGUACAAG | 4556 |
| AD-953507.1 | A-1701075.1 | 1111 | usgsgug(Chd)uadCudGuuuauccguaL96 | A-1800410.1 | 1241 | VPusdAscgdGadTaaacdAgdTadGcaccasasu | AUUGGUGCUACUGUUUAUCCGUA | 4557 |
| AD-953451.1 | A-1700963.1 | 1112 | asgsgca(Ghd)cudTgdAguuaaacgaaL96 | A-1800354.1 | 1242 | VPusdTscgdTudTaacudCadAgdCugccuscsg | CGAGGCAGCUUGAGUUAAACGAA | 4558 |
| AD-953429.1 | A-1700919.1 | 1113 | gscsacu(Ghd)aadAcdTuuucguccaaL96 | A-1800332.1 | 1243 | VPusdTsggdAcdGaaaadGudTudCagugcsgsa | UCGCACUGAAACUUUUCGUCCAA | 4559 |
| AD-953469.1 | A-1700999.1 | 1114 | gsascug(Ahd)uadCadGaacgaucgaaL96 | A-1800372.1 | 1244 | VPusdTscgdAudCguucdTgdTadTcagucsusu | AAGACUGAUACAGAACGAUCGAU | 4560 |
| AD-953463.1 | A-1700987.1 | 1115 | ascsgaa(Chd)gudAcdTugcagauguaL96 | A-1800366.1 | 1245 | VPusdAscadTcdTgcaadGudAcdGuucgusu | AAACGAACGUACUUGCAGAUGUG | 4561 |
| AD-953454.1 | A-1700969.1 | 1116 | csasgcu(Uhd)gadGudTaaacgaacgaL96 | A-1800357.1 | 1246 | VPusdCsgudTcdGuuuadAcdTcdAagcugscsc | GGCAGCUUGAGUUAAACGAACGU | 4562 |
| AD-953455.1 | A-1700971.1 | 1117 | asgscuu(Ghd)agdTudAaacgaacguaL96 | A-1800358.1 | 1247 | VPusdAscgdTudCguuudAadCudCaagcusgsc | GCAGCUUGAGUUAAACGAACGUA | 4563 |
| AD-953511.1 | A-1701083.1 | 1118 | gsasuau(Uhd)aadCadTcacgucuuuaL96 | A-1800414.1 | 1248 | VPusdAsaadGadCgugadTgdTudAauaucsusu | AAGAUAUUAACAUCACGUCUUUG | 4564 |
| AD-953447.1 | A-1700955.1 | 1119 | cscsugc(Ahd)aadAadCacagacucgaL96 | A-1800350.1 | 1249 | VPusdCsgadGudCugugdTudTudTgcaggsasa | UUCCUGCAAAAACACAGACUCGC | 4565 |

TABLE 4A-continued

Exemplary Human VEGF-A siRNA Modified Single Strandsand Duplex Sequences

| Duplex Name | Sense Oligo Name | SEQ ID NO: (Sense) | Sense Sequence | Antisense Oligo Name | SEQ ID NO: (Anti-sense) | Antisense Sequence | mRNA target sequence | SEQ ID NO: (mRNA target) |
|---|---|---|---|---|---|---|---|---|
| AD-953424.1 | A-1700909.1 | 1120 | gsusgcu(Ghd)gadAudTugauauucaaL96 | A-1800327.1 | 1250 | VPusdTsgadAudAucaadAudTcdCagcacscsg | CGGUGCUGGAAUUUGAUAUUCAU | 4566 |
| AD-953506.1 | A-1701073.1 | 1121 | ususggu(Ghd)cudAcdTguuuauccgaL96 | A-1800409.1 | 1251 | VPusdCsggdAudAaacadGudAgdCaccaasusa | UAUUGGUGCUACUGUUUAUCCGU | 4567 |
| AD-953537.1 | A-1701135.1 | 1122 | asusugg(Uhd)gudCudTcacuggaugaL96 | A-1800440.1 | 1252 | VPusdCsaudCcdAgugadAgdAcdAccaausasa | UUAUUGGUGUCUUCACUGGAUGU | 4568 |
| AD-953477.1 | A-1701015.1 | 1123 | uscsuug(Chd)ugdCudAaaucaccgaaL96 | A-1800380.1 | 1253 | VPusdTscgdGudGauuudAgdCadGcaagasasa | UUUCUUGCUGCUAAAUCACCGAG | 4569 |
| AD-953479.1 | A-1701019.1 | 1124 | ususgcu(Ghd)cudAadAucaccgagcaL96 | A-1800382.1 | 1254 | VPusdGscudCgdGugaudTudAgdCagcaasgsa | UCUUGCUGCUAAAUCACCGAGCC | 4570 |
| AD-953439.1 | A-1700939.1 | 1125 | asgsauu(Ahd)ugdCgdGaucaaaccuaL96 | A-1800342.1 | 1255 | VPusdAsggdTudTgaucdCgdCadTaaucusgsc | GCAGAUUAUGCGGAUCAAACCUC | 4571 |
| AD-953431.1 | A-1700923.1 | 1126 | gsgsgca(Ghd)aadTcdAucacgaaguaL96 | A-1800334.1 | 1256 | VPusdAscudTcdGugaudGadTudCugcccsusc | GAGGGCAGAAUCAUCACGAAGUG | 4572 |
| AD-953442.1 | A-1700945.1 | 1127 | asusuug(Uhd)uudGudAcaagauccgaL96 | A-1800345.1 | 1257 | VPusdCsggdAudCuugudAcdAadAcaaausgsc | GCAUUUGUUUGUACAAGAUCCGC | 4573 |
| AD-953449.1 | A-1700959.1 | 1128 | csasaaa(Ahd)cadCadGacucgcguuaL96 | A-1800352.1 | 1258 | VPusdAsacdGcdGagucdTgdTgdTuuuugscsa | UGCAAAAACACAGACUCGCGUUG | 4574 |
| AD-953510.1 | A-1701081.1 | 1129 | usgscua(Chd)ugdTudTauccguaauaL96 | A-1800413.1 | 1259 | VPusdAsuudAcdGgauadAadCadGuagcascsc | GGUGCUACUGUUUAUCCGUAAUA | 4575 |
| AD-953514.1 | A-1701089.1 | 1130 | ascsuuu(Uhd)cgdTcdCaacuucuggaL96 | A-1800417.1 | 1260 | VPusdCscadGadAguugdGadCgdAaaagusu | AAACUUUUCGUCCAACUUCUGGG | 4576 |
| AD-953508.1 | A-1701077.1 | 1131 | gsgsugc(Uhd)acdTgdTuuauccguaaL96 | A-1800411.1 | 1261 | VPusdTsacdGgdAuaaadCadGudAgcaccsasa | UUGGUGCUACUGUUUAUCCGUAA | 4577 |
| AD-953531.1 | A-1701123.1 | 1132 | gscsaaa(Ahd)acdAcdAgacucgcguaL96 | A-1800434.1 | 1262 | VPusdAscgdCgdAgucudGudGudTuuugcsasg | CUGCAAAAACACAGACUCGCGUU | 4578 |
| AD-953427.1 | A-1700915.1 | 1133 | csgsucg(Chd)acdTgdAaacuuuucgaL96 | A-1800330.1 | 1263 | VPusdCsgadAadAguuudCadGudGcgacgscsc | GGCGUCGCACUGAAACUUUUCGU | 4579 |
| AD-953512.1 | A-1701085.1 | 1134 | asusauu(Ahd)acdAudCacgucuuugaL96 | A-1800415.1 | 1264 | VPusdCsaadAgdAcgugdAudGudTaauauscsu | AGAUAUUAACAUCACGUCUUUGU | 4580 |
| AD-953533.1 | A-1701127.1 | 1135 | asasaac(Ahd)cadGadCucgcguugcaL96 | A-1800436.1 | 1265 | VPusdGscadAcdGcgagdTcdTgdTguuuusgsg | CAAAAACACAGACUCGCGUUGCA | 4581 |
| AD-953464.1 | A-1700989.1 | 1136 | csusugc(Ahd)gadTgdTgacaagccgaL96 | A-1800367.1 | 1266 | VPusdCsggdCudTgucadCadTcdTgcaagsusa | UACUUGCAGAUGUGACAAGCCGA | 4582 |
| AD-953542.1 | A-1701145.1 | 1137 | ususuuu(Uhd)uudCadGuauucuuggaL96 | A-1800445.1 | 1267 | VPusdCscadAgdAauacdTgdAadAaaaaascsc | GGUUUUUUUCAGUAUUCUUGGU | 4583 |

TABLE 4A-continued

| Duplex Name | Sense Oligo Name | SEQ ID NO: (Sense) | Sense Sequence | Antisense Oligo Name | SEQ ID NO: (Anti-sense) | Antisense Sequence | mRNA target sequence | SEQ ID NO: (mRNA target) |
|---|---|---|---|---|---|---|---|---|
| Exemplary Human VEGF-A siRNA Modified Single Strandsand Duplex Sequences | | | | | | | | |
| AD-953426.1 | A-1700913.1 | 1138 | asasagu(Ghd)agdTgdAccugcuuuuaL96 | A-1800329.1 | 1268 | VPusdAsaadAgdCaggudCadCudCacuuusgsc | GCAAAGUGAGUGACCUGCUUUUG | 4584 |
| AD-953515.1 | A-1701091.1 | 1139 | ususcgu(Chd)cadAcdTucugggcugaL96 | A-1800418.1 | 1269 | VPusdCsagdCcdCagaadGudTgdGacgaasasa | UUUUCGUCCAACUUCUGGGCUGU | 4585 |
| AD-953487.1 | A-1701035.1 | 1140 | asgsgac(Ahd)uudGcdTgugcuuuggaL96 | A-1800390.1 | 1270 | VPusdCscadAadGcacadGcdAadTguccusgsa | UCAGGACAUUGCUGUGCUUUGGG | 4586 |
| AD-953521.1 | A-1701103.1 | 1141 | asasauc(Ahd)gudTcdGaggaaagggaL96 | A-1800424.1 | 1271 | VPusdCsccdTudTccucdGadAcdTgauuususu | AAAAAUCAGUUCGAGGAAAGGGA | 4587 |
| AD-953425.1 | A-1700911.1 | 1142 | ususccc(Chd)aadAudCacuguggauaL96 | A-1800328.1 | 1272 | VPusdAsucdCadCagugdAudTudGgggaasgsu | ACUUCCCCAAAUCACUGUGGAUU | 4588 |
| AD-953536.1 | A-1701133.1 | 1143 | cscscuc(Uhd)ugdGadAuuggauucgaL96 | A-1800439.1 | 1273 | VPusdCsgadAudCcaaudTcdCadAgagggsasc | GUCCCUCUUGGAAUUGGAUUCGC | 4589 |
| AD-953465.1 | A-1700991.1 | 1144 | ususgca(Ghd)audGudGacaagccgaaL96 | A-1800368.1 | 1274 | VPusdTscgdGcdTugucdAcdAudCugcaasgsu | ACUUGCAGAUGUGACAAGCCGAG | 4590 |
| AD-953552.1 | A-1701165.1 | 1145 | csascgu(Chd)uudTgdTcucuagugcaL96 | A-1800455.1 | 1275 | VPusdGscadCudAgagadCadAadGacgugsasu | AUCACGUCUUUGUCUCUAGUGCA | 4591 |
| AD-953528.1 | A-1701117.1 | 1146 | gsasucc(Ghd)cadGadCguguaaaugaL96 | A-1800431.1 | 1276 | VPusdCsaudTudAcacgdTcdTgdCggaucsusu | AAGAUCCGCAGACGUGUAAAUGU | 4592 |
| AD-953519.1 | A-1701099.1 | 1147 | asasaaa(Uhd)cadGudTcgaggaaagaL96 | A-1800422.1 | 1277 | VPusdCsuudTcdCucgadAcdTgdAuuuuusus u | AAAAAAAUCAGUUCGAGGAAAGG | 4593 |
| AD-953486.1 | A-1701033.1 | 1148 | usgscug(Uhd)ggdAcdTugaguugggaL96 | A-1800389.1 | 1278 | VPusdCsccdAadCucaadGudCcdAcagcasgsu | ACUGCUGUGGACUUGAGUUGGGA | 4594 |
| AD-953522.1 | A-1701105.1 | 1149 | asasggg(Ghd)cadAadAacgaaagcgaL96 | A-1800425.1 | 1279 | VPusdCsgcdTudTcguudTudTgdCcccuususc | GAAAGGGGCAAAAACGAAAGCGC | 4595 |
| AD-953530.1 | A-1701121.1 | 1150 | usgscaa(Ahd)aadCadCagacucgcgaL96 | A-1800433.1 | 1280 | VPusdCsgcdGadGucugdTgdTudTugcasgsg | CCUGCAAAAACACAGACUCGCGU | 4596 |
| AD-953513.1 | A-1701087.1 | 1151 | ascsguc(Uhd)uudGudCucuagugcaaL96 | A-1800416.1 | 1281 | VPusdTsgcdAcdTagagdAcdAadAgacgusgsa | UCACGUCUUUGUCUCUAGUGCAG | 4597 |
| AD-953441.1 | A-1700943.1 | 1152 | gsgsgca(Ahd)aadAcdGaaagcgcaaaL96 | A-1800344.1 | 1282 | VPusdTsugdCgdCuucdGudTudTugcccscsu | AGGGGCAAAAACGAAAGCGCAAG | 4598 |
| AD-953440.1 | A-1700941.1 | 1153 | asgsggg(Chd)aadAadAcgaaagcgcaL96 | A-1800343.1 | 1283 | VPusdGscgdCudTucgudTudTudGccccusu su | AAAGGGGCAAAAACGAAAGCGCA | 4599 |
| AD-953518.1 | A-1701097.1 | 1154 | gsasaaa(Ahd)aadAudCaguucgaggaL96 | A-1800421.1 | 1284 | VPusdCscudCgdAacugdAudTudTuuuucsusu | AAGAAAAAAAAUCAGUUCGAGGA | 4600 |
| AD-953520.1 | A-1701101.1 | 1155 | asasaau(Chd)agdTudCgaggaaaggaL96 | A-1800423.1 | 1285 | VPusdCscudTudCcucgdAadCudGauuuususu | AAAAAAUCAGUUCGAGGAAAGGG | 4601 |

TABLE 4A-continued

Exemplary Human VEGF-A siRNA Modified Single Strandsand Duplex Sequences

| Duplex Name | Sense Oligo Name | SEQ ID NO: (Sense) | Sense Sequence | Antisense Oligo Name | SEQ ID NO: (Anti-sense) | Antisense Sequence | mRNA target sequence | SEQ ID NO: (mRNA target) |
|---|---|---|---|---|---|---|---|---|
| AD-953532.1 | A-1701125.1 | 1156 | asasaaa(Chd)acdAgdAcucgcguugaL96 | A-1800435.1 | 1286 | VPusdCsaadCgdCgagudCudGudGuuuuusgsc | GCAAAAACACAGACUCGCGUUGC | 4602 |
| AD-953548.1 | A-1701157.1 | 1157 | ususuau(Chd)cgdTadAuaauuguggaL96 | A-1800451.1 | 1287 | VPusdCscadCadAuuaudTadCgdGauaaascsa | UGUUUAUCCGUAAUAAUUGUGGG | 4603 |
| AD-953527.1 | A-1701115.1 | 1158 | asgsauc(Chd)gcdAgdAcguguaaauaL96 | A-1800430.1 | 1288 | VPusdAsuudTadCacgudCudGcdGgaucusug | CAAGAUCCGCAGACGUGUAAAUG | 4604 |
| AD-953551.1 | A-1701163.1 | 1159 | ususaac(Ahd)ucdAcdGucuuugucuaL96 | A-1800454.1 | 1289 | VPusdAsgadCadAagacdGudGadTguuaasusa | UAUUAACAUCACGUCUUUGUCUC | 4605 |
| AD-953553.1 | A-1701167.1 | 1160 | csgsucu(Uhd)ugdTcdTcuagugcagaL96 | A-1800456.1 | 1290 | VPusdCsugdCadCuagadGadCadAagacgsusg | CACGUCUUUGUCUCUAGUGCAGU | 4606 |
| AD-953547.1 | A-1701155.1 | 1161 | gsusuua(Uhd)ccdGudAauaauugugaL96 | A-1800450.1 | 1291 | VPusdCsacdAadTuauudAcdGgdAuaaacsasg | CUGUUUAUCCGUAAUAAUUGUGG | 4607 |
| AD-953526.1 | A-1701113.1 | 1162 | ususguu(Uhd)gudAcdAagauccgcaaL96 | A-1800429.1 | 1292 | VPusdTsgcdGgdAucuudGudAcdAaacaasasu | AUUUGUUUGUACAAGAUCCGCAG | 4608 |
| AD-953549.1 | A-1701159.1 | 1163 | ususauc(Chd)gudAadTaauugugggaL96 | A-1800452.1 | 1293 | VPusdCsccdAcdAauuadTudAcdGgauaaasasc | GUUUAUCCGUAAUAAUUGUGGGG | 4609 |
| AD-953534.1 | A-1701129.1 | 1164 | asascac(Ahd)gadCudCgcguugcaaaL96 | A-1800437.1 | 1294 | VPusdTsugdCadAcgcgdAgdTcdTguguususu | AAAACACAGACUCGCGUUGCAAG | 4610 |
| AD-953543.1 | A-1701147.1 | 1165 | ususuuu(Uhd)ucdAgdTauucuugguaL96 | A-1800446.1 | 1295 | VPusdAsccdAadGaauadCudGadAaaaaasasc | GUUUUUUUUCAGUAUUCUUGGUU | 4611 |
| AD-953550.1 | A-1701161.1 | 1166 | asusuaa(Chd)audCadCgucuuugucaL96 | A-1800453.1 | 1296 | VPusdGsacdAadAgacgdTgdAudGuuaausasu | AUAUUAACAUCACGUCUUUGUCU | 4612 |

TABLE 4B

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-953504.1 | A-1701069.1 | 1297 | AAAAUAGACAUGCUAUUCUA | 3361-3381 | A-1800407.1 | 1427 | UAGAAUAGCAAUGUCUAUUUUAU | 3359-3381 |
| AD-953481.1 | A-1701023.1 | 1298 | AGUGCUAAUGUUAUUGGUGUA | 2181-2201 | A-1800384.1 | 1428 | UACACCAAUAACAUUAGCACUGU | 2179-2201 |
| AD-953472.1 | A-1701005.1 | 1299 | AUACAGAACGAUCGAUACAGA | 1803-1823 | A-1800375.1 | 1429 | UCUGUAUCGAUCGUUCUGUAUCA | 1801-1823 |
| AD-953517.1 | A-1701095.1 | 1300 | ACAGCACAACAAAUGUGAAUA | 1407-1427 | A-1800420.1 | 1430 | UAUUCACAUUUGUUGUGCUGUAG | 1405-1427 |

TABLE 4B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-953471.1 | A-1701003.1 | 1301 | CUGAUACAGAACGAUCGAUAA | 1800-1820 | A-1800374.1 | 1431 | UTAUCGAUCGUTCTGTAUCAGUC | 1798-1820 |
| AD-953493.1 | A-1701047.1 | 1302 | GAGAAAGUGUTUUAUAUACGA | 2944-2964 | A-1800396.1 | 1432 | UCGUAUAUAAAACACTUUCUCUU | 2942-2964 |
| AD-953498.1 | A-1701057.1 | 1303 | AACUAUUUAUGAGAUGUAUCA | 3062-3082 | A-1800401.1 | 1433 | UGAUACAUCUCAUAAAUAGUUGA | 3060-3082 |
| AD-953467.1 | A-1700995.1 | 1304 | AAGACUGAUACAGAACGAUCA | 1796-1816 | A-1800370.1 | 1434 | UGAUCGTUCUGTAUCAGUCUUUC | 1794-1816 |
| AD-953545.1 | A-1701151.1 | 1305 | GAGAAUUCTACAUACUAAAUA | 3416-3436 | A-1800448.1 | 1435 | UAUUTAGUAUGTAGAAUUCUCUA | 3414-3436 |
| AD-953466.1 | A-1700993.1 | 1306 | AAAGACUGAUACAGAACGAUA | 1795-1815 | A-1800369.1 | 1436 | UAUCGUTCUGUAUCAGUCUUUCC | 1793-1815 |
| AD-953494.1 | A-1701049.1 | 1307 | ACGGUACUTAUUUAAUAUCCA | 2961-2981 | A-1800397.1 | 1437 | UGGATATUAAAUAAGTACCGUAU | 2959-2981 |
| AD-953470.1 | A-1701001.1 | 1308 | ACUGAUACAGAACGAUCGAUA | 1799-1819 | A-1800373.1 | 1438 | UAUCGATCGUUCUGUAUCAGUCU | 1797-1819 |
| AD-953473.1 | A-1701007.1 | 1309 | CGACAGAACAGUCCUUAAUCA | 1855-1875 | A-1800376.1 | 1439 | UGAUTAAGGACTGUTCUGUCGAU | 1853-1875 |
| AD-953474.1 | A-1701009.1 | 1310 | CAGAACAGTCCUUAAUCCAGA | 1858-1878 | A-1800377.1 | 1440 | UCUGGATUAAGGACUGUUCUGUC | 1856-1878 |
| AD-953480.1 | A-1701021.1 | 1311 | AACAGUGCTAAUGUUAUUGGA | 2178-2198 | A-1800383.1 | 1441 | UCCAAUAACAUTAGCACUGUUAA | 2176-2198 |
| AD-953503.1 | A-1701067.1 | 1312 | ACAGUCACTAGCUUAUCUUGA | 3164-3184 | A-1800406.1 | 1442 | UCAAGATAAGCTAGUGACUGUCA | 3162-3184 |
| AD-953478.1 | A-1701017.1 | 1313 | CUUGCUGCTAAAUCACCGAGA | 2011-2031 | A-1800381.1 | 1443 | UCUCGGTGAUUTAGCAGCAAGAA | 2009-2031 |
| AD-953540.1 | A-1701141.1 | 1314 | GAAAGUGUTUTAUAUACGGUA | 2946-2966 | A-1800443.1 | 1444 | UACCGUAUAUAAAACACUUUCUC | 2944-2966 |
| AD-953500.1 | A-1701061.1 | 1315 | GCUCUCUUAUTUGUACCGGUA | 3096-3116 | A-1800403.1 | 1445 | UACCGGTACAAAUAAGAGAGCAA | 3094-3116 |
| AD-953476.1 | A-1701013.1 | 1316 | UUCUUGCUGCTAAAUCACCGA | 2009-2029 | A-1800379.1 | 1446 | UCGGTGAUUUAGCAGCAAGAAAA | 2007-2029 |
| AD-953492.1 | A-1701045.1 | 1317 | CACCAUUGAAACCACUAGUUA | 2791-2811 | A-1800395.1 | 1447 | UAACTAGUGGUTUCAAUGGUGUG | 2789-2811 |
| AD-953495.1 | A-1701051.1 | 1318 | CGGUACUUAUUUAAUAUCCCA | 2962-2982 | A-1800398.1 | 1448 | UGGGAUAUUAAAUAAGUACCGUA | 2960-2982 |

TABLE 4B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-953497.1 | A-1701055.1 | 1319 | CAACUAUUUAUGAGAUGUAUA | 3061-3081 | A-1800400.1 | 1449 | UAUACAUCUCAUAAAUAGUUGAA | 3059-3081 |
| AD-953535.1 | A-1701131.1 | 1320 | UAAUCCAGAAACCUGAAAUGA | 1870-1890 | A-1800438.1 | 1450 | UCAUUUCAGGUUUCUGGAUUAAG | 1868-1890 |
| AD-953505.1 | A-1701071.1 | 1321 | AAAUAGACAUUGCUAUUCUGA | 3362-3382 | A-1800408.1 | 1451 | UCAGAAUAGCAAUGUCUAUUUUA | 3360-3382 |
| AD-953524.1 | A-1701109.1 | 1322 | AAAGCAUUUGUUUGUACAAGA | 1611-1631 | A-1800427.1 | 1452 | UCUUGUACAAACAAAUGCUUUCU | 1609-1631 |
| AD-953475.1 | A-1701011.1 | 1323 | CUUGGAAUUGGAUUCGCCAUA | 1982-2002 | A-1800378.1 | 1453 | UAUGGCGAAUCCAAUUCCAAGAG | 1980-2002 |
| AD-953491.1 | A-1701043.1 | 1324 | ACACCAUUGAAACCACUAGUA | 2790-2810 | A-1800394.1 | 1454 | UACUAGUGGUUUCAAUGGUGUGA | 2788-2810 |
| AD-953436.1 | A-1700933.1 | 1325 | AACAUCACCAUGCAGAUUAUA | 1339-1359 | A-1800339.1 | 1455 | UAUAAUCUGCAUGGUGAUGUUGG | 1337-1359 |
| AD-953502.1 | A-1701065.1 | 1326 | UGACAGUCACUAGCUUAUCUA | 3162-3182 | A-1800405.1 | 1456 | UAGAUAAGCUAGUGACUGUCACC | 3160-3182 |
| AD-953461.1 | A-1700983.1 | 1327 | AGUUAAACGAACGUACUUGCA | 1694-1714 | A-1800364.1 | 1457 | UGCAAGUACGUUCGUUUAACUCA | 1692-1714 |
| AD-953544.1 | A-1701149.1 | 1328 | ACUAUUUAUGAGAUGUAUCUA | 3063-3083 | A-1800447.1 | 1458 | UAGAUACAUCUCAUAAAUAGUUG | 3061-3083 |
| AD-953462.1 | A-1700985.1 | 1329 | UUAAACGAACGUACUUGCAGA | 1696-1716 | A-1800365.1 | 1459 | UCUGCAAGUACGUUCGUUUAACU | 1694-1716 |
| AD-953496.1 | A-1701053.1 | 1330 | GGUACUUAUUUAAUAUCCCUA | 2963-2983 | A-1800399.1 | 1460 | UAGGGAUAUUAAAUAAGUACCGU | 2961-2983 |
| AD-953516.1 | A-1701093.1 | 1331 | CGAAGUGGUGAAGUUCAUGGA | 1152-1172 | A-1800419.1 | 1461 | UCCAUGAACUUCACCACUUCGUG | 1150-1172 |
| AD-953483.1 | A-1701027.1 | 1332 | UGUUAUUGGUGUCUUCACUGA | 2189-2209 | A-1800386.1 | 1462 | UCAGUGAAGACACCAAUAACAUU | 2187-2209 |
| AD-953499.1 | A-1701059.1 | 1333 | UUGCUCUCUUAUUUGUACCGA | 3094-3114 | A-1800402.1 | 1463 | UCGGUACAAAUAAGAGAGCAAGA | 3092-3114 |
| AD-953541.1 | A-1701143.1 | 1334 | GUUUUAUAUACGGUACUUAUA | 2952-2972 | A-1800444.1 | 1464 | UAUAAGUACCGUAUAUAAAACAC | 2950-2972 |
| AD-953538.1 | A-1701137.1 | 1335 | UCACUGGAUGUAUUUGACUGA | 2203-2223 | A-1800441.1 | 1465 | UCAGUCAAAUACAUCCAGUGAAG | 2201-2223 |
| AD-953430.1 | A-1700921.1 | 1336 | CCUCCGAAACCAUGAACUUUA | 1028-1048 | A-1800333.1 | 1466 | UAAAGUUCAUGGUUUCGGAGGCC | 1026-1048 |

TABLE 4B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-953485.1 | A-1701031.1 | 1337 | UAUUGGUGTCUUCACUGGAUA | 2192-2212 | A-1800388.1 | 1467 | UAUCCAGUGAAGACACCAAUAAC | 2190-2212 |
| AD-953468.1 | A-1700997.1 | 1338 | AGACUGAUACAGAACGAUCGA | 1797-1817 | A-1800371.1 | 1468 | UCGATCGUUCUGUAUCAGUCUUU | 1795-1817 |
| AD-953444.1 | A-1700949.1 | 1339 | UCCGCAGACGTGUAAAUGUUA | 1632-1652 | A-1800347.1 | 1469 | UAACAUTUACACGUCUGCGGAUC | 1630-1652 |
| AD-953460.1 | A-1700981.1 | 1340 | GAGUUAAACGAACGUACUUGA | 1693-1713 | A-1800363.1 | 1470 | UCAAGUACGUUCGUTUAACUCAA | 1691-1713 |
| AD-953539.1 | A-1701139.1 | 1341 | AGAAAGUGTUTUAUAUACGGA | 2945-2965 | A-1800442.1 | 1471 | UCCGTAUAUAAAACACUUUCUCU | 2943-2965 |
| AD-953484.1 | A-1701029.1 | 1342 | GUUAUUGGTGTCUUCACUGGA | 2190-2210 | A-1800387.1 | 1472 | UCCAGUGAAGACACCAAUAACAU | 2188-2210 |
| AD-953457.1 | A-1700975.1 | 1343 | CUUGAGUUAAACGAACGUACA | 1690-1710 | A-1800360.1 | 1473 | UGUACGTUCGUUAACUCAAGCU | 1688-1710 |
| AD-953459.1 | A-1700979.1 | 1344 | UGAGUUAAACGAACGUACUUA | 1692-1712 | A-1800362.1 | 1474 | UAAGTACGUUCGUUAACUCAAG | 1690-1712 |
| AD-953437.1 | A-1700935.1 | 1345 | AUCACCAUGCAGAUUAUGCGA | 1342-1362 | A-1800340.1 | 1475 | UCGCAUAAUCUGCAUGGUGAUGU | 1340-1362 |
| AD-953458.1 | A-1700977.1 | 1346 | UUGAGUUAAACGAACGUACUA | 1691-1711 | A-1800361.1 | 1476 | UAGUACGUUCGUTUAACUCAAGC | 1689-1711 |
| AD-953453.1 | A-1700967.1 | 1347 | GCAGCUUGAGTUAAACGAACA | 1686-1706 | A-1800356.1 | 1477 | UGUUCGTUUAACUCAAGCUGCCU | 1684-1706 |
| AD-953428.1 | A-1700917.1 | 1348 | CGCACUGAAACUUUUCGUCCA | 648-668 | A-1800331.1 | 1478 | UGGACGAAAAGTUTCAGUGCGAC | 646-668 |
| AD-953501.1 | A-1701063.1 | 1349 | UCGGUGACAGTCACUAGCUUA | 3158-3178 | A-1800404.1 | 1479 | UAAGCUAGUGACUGUCACCGAUC | 3156-3178 |
| AD-953482.1 | A-1701025.1 | 1350 | GUGCUAAUGUTAUUGGUGUCA | 2182-2202 | A-1800385.1 | 1480 | UGACACCAAUAACAUTAGCACUG | 2180-2202 |
| AD-953446.1 | A-1700953.1 | 1351 | CGCAGACGTGTAAAUGUUCCA | 1634-1654 | A-1800349.1 | 1481 | UGGAACAUUUACACGTCUGCGGA | 1632-1654 |
| AD-953488.1 | A-1701037.1 | 1352 | AGAGAAGAGACACAUUGUUGA | 2673-2693 | A-1800391.1 | 1482 | UCAACAAUGUGTCTCTUCUCUUC | 2671-2693 |
| AD-953434.1 | A-1700929.1 | 1353 | UGAAGUUCAUGGAUGUCUAUA | 1160-1180 | A-1800337.1 | 1483 | UAUAGACAUCCAUGAACUUCACC | 1158-1180 |
| AD-953546.1 | A-1701153.1 | 1354 | AAUUCUACAUACUAAAUCUCA | 3419-3439 | A-1800449.1 | 1484 | UGAGAUTUAGUAUGUAGAAUUCU | 3417-3439 |

TABLE 4B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-953529.1 | A-1701119.1 | 1355 | CAGACGUGTAAAUGUUCCUGA | 1636-1656 | A-1800432.1 | 1485 | UCAGGAACAUUTACACGUCUGCG | 1634-1656 |
| AD-953433.1 | A-1700927.1 | 1356 | CACGAAGUGGTGAAGUUCAUA | 1150-1170 | A-1800336.1 | 1486 | UAUGAACUUCACCACTUCGUGAU | 1148-1170 |
| AD-953456.1 | A-1700973.1 | 1357 | GCUUGAGUTAAACGAACGUAA | 1689-1709 | A-1800359.1 | 1487 | UTACGUTCGUUTAACTCAAGCUG | 1687-1709 |
| AD-953435.1 | A-1700931.1 | 1358 | CAUCUUCAAGCCAUCCUGUGA | 1251-1271 | A-1800338.1 | 1488 | UCACAGGAUGGCUTGAAGAUGUA | 1249-1271 |
| AD-953438.1 | A-1700937.1 | 1359 | CACCAUGCAGAUUAUGCGGAA | 1344-1364 | A-1800341.1 | 1489 | UTCCGCAUAAUCUGCAUGGUGAU | 1342-1364 |
| AD-953452.1 | A-1700965.1 | 1360 | GGCAGCUUGAGUUAAACGAAA | 1685-1705 | A-1800355.1 | 1490 | UTUCGUTUAACTCAAGCUGCCUC | 1683-1705 |
| AD-953489.1 | A-1701039.1 | 1361 | AUGUCCUCACACCAUUGAAAA | 2782-2802 | A-1800392.1 | 1491 | UTUUCAAUGGUGUGAGGACAUAG | 2780-2802 |
| AD-953445.1 | A-1700951.1 | 1362 | CCGCAGACGUGUAAAUGUUCA | 1633-1653 | A-1800348.1 | 1492 | UGAACAUUUACACGUCUGCGGAU | 1631-1653 |
| AD-953432.1 | A-1700925.1 | 1363 | CAGAAUCAUCACGAAGUGGUA | 1141-1161 | A-1800335.1 | 1493 | UACCACTUCGUGATGAUUCUGCC | 1139-1161 |
| AD-953509.1 | A-1701079.1 | 1364 | GUGCUACUGUTUAUCCGUAAA | 3481-3501 | A-1800412.1 | 1494 | UTUACGGAUAAACAGTAGCACCA | 3479-3501 |
| AD-953490.1 | A-1701041.1 | 1365 | UGUCCUCACACCAUUGAAACA | 2783-2803 | A-1800393.1 | 1495 | UGUUTCAAUGGTGTGAGGACAUA | 2781-2803 |
| AD-953448.1 | A-1700957.1 | 1366 | CUGCAAAAACACAGACUCGCA | 1653-1673 | A-1800351.1 | 1496 | UGCGAGTCUGUGUTUTUGCAGGA | 1651-1673 |
| AD-953450.1 | A-1700961.1 | 1367 | GAGGCAGCTUGAGUUAAACGA | 1683-1703 | A-1800353.1 | 1497 | UCGUTUAACUCAAGCTGCCUCGC | 1681-1703 |
| AD-953443.1 | A-1700947.1 | 1368 | AUCCGCAGACGUGUAAAUGUA | 1631-1651 | A-1800346.1 | 1498 | UACAUTUACACGUCUGCGGAUCU | 1629-1651 |
| AD-953525.1 | A-1701111.1 | 1369 | GCAUUUGUTUGUACAAGAUCA | 1614-1634 | A-1800428.1 | 1499 | UGAUCUTGUACAAACAAAUGCUU | 1612-1634 |
| AD-953523.1 | A-1701107.1 | 1370 | GAAAGCAUTUGUUUGUACAAA | 1610-1630 | A-1800426.1 | 1500 | UTUGTACAAACAAAUGCUUUCUC | 1608-1630 |
| AD-953507.1 | A-1701075.1 | 1371 | UGGUGCUACUGUUUAUCCGUA | 3479-3499 | A-1800410.1 | 1501 | UACGGATAAACAGTAGCACCAAU | 3477-3499 |
| AD-953451.1 | A-1700963.1 | 1372 | AGGCAGCUTGAGUUAAACGAA | 1684-1704 | A-1800354.1 | 1502 | UTCGTUTAACUCAAGCUGCCUCG | 1682-1704 |

TABLE 4B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-953429.1 | A-1700919.1 | 1373 | GCACUGAAACUUUUCGUCCAA | 649-669 | A-1800332.1 | 1503 | UTGGACGAAAAGUTUCAGUGCGA | 647-669 |
| AD-953469.1 | A-1700999.1 | 1374 | GACUGAUACAGAACGAUCGAA | 1798-1818 | A-1800372.1 | 1504 | UTCGAUCGUUCTGUAUCAGUCUU | 1796-1818 |
| AD-953463.1 | A-1700987.1 | 1375 | ACGAACGUACUGCAGAUGUA | 1700-1720 | A-1800366.1 | 1505 | UACAUCTGCAAGUACGUUCGUUU | 1698-1720 |
| AD-953454.1 | A-1700969.1 | 1376 | CAGCUUGAGUTAAACGAACGA | 1687-1707 | A-1800357.1 | 1506 | UCGUTCGUUUAACTCAAGCUGCC | 1685-1707 |
| AD-953455.1 | A-1700971.1 | 1377 | AGCUUGAGUAAACGAACGUA | 1688-1708 | A-1800358.1 | 1507 | UACGUTCGUUUAACUCAAGCUGC | 1686-1708 |
| AD-953511.1 | A-1701083.1 | 1378 | GAUAUUAACAUCACGUCUUUA | 3516-3536 | A-1800414.1 | 1508 | UAAAGACGUGAUGTUAAUAUCUU | 3514-3536 |
| AD-953447.1 | A-1700955.1 | 1379 | CCUGCAAAAACACAGACUCGA | 1652-1672 | A-1800350.1 | 1509 | UCGAGUCUGUGUTUTUGCAGGAA | 1650-1672 |
| AD-953424.1 | A-1700909.1 | 1380 | GUGCUGGAAUUGAUAUUCAA | 125-145 | A-1800327.1 | 1510 | UTGAAUAUCAAAUTCCAGCACCG | 123-145 |
| AD-953506.1 | A-1701073.1 | 1381 | UUGGUGCUACUGUUUAUCCGA | 3478-3498 | A-1800409.1 | 1511 | UCGGAUAAACAGUAGCACCAAUA | 3476-3498 |
| AD-953537.1 | A-1701135.1 | 1382 | AUUGGUGUCUUCACUGGAUGA | 2193-2213 | A-1800440.1 | 1512 | UCAUCCAGUGAAGACACCAAUAA | 2191-2213 |
| AD-953477.1 | A-1701015.1 | 1383 | UCUUGCUGCUAAAUCACCGAA | 2010-2030 | A-1800380.1 | 1513 | UTCGGUGAUUUAGCAGCAAGAAA | 2008-2030 |
| AD-953479.1 | A-1701019.1 | 1384 | UUGCUGCUAAAUCACCGAGCA | 2012-2032 | A-1800382.1 | 1514 | UGCUCGGUGAUUAGCAGCAAGA | 2010-2032 |
| AD-953439.1 | A-1700939.1 | 1385 | AGAUUAUGCGGAUCAAACCUA | 1352-1372 | A-1800342.1 | 1515 | UAGGUTUGAUCCGCAUAAUCUGC | 1350-1372 |
| AD-953431.1 | A-1700923.1 | 1386 | GGGCAGAAUCAUCACGAAGUA | 1138-1158 | A-1800334.1 | 1516 | UACUUCGUGAUGAUUCUGCCCUC | 1136-1158 |
| AD-953442.1 | A-1700945.1 | 1387 | AUUUGUUUGUACAAGAUCCGA | 1616-1636 | A-1800345.1 | 1517 | UCGGAUCUUGUACAAACAAAUGC | 1614-1636 |
| AD-953449.1 | A-1700959.1 | 1388 | CAAAAACACAGACUCGCGUUA | 1656-1676 | A-1800352.1 | 1518 | UAACGCGAGUCTGUGUUUUUGCA | 1654-1676 |
| AD-953510.1 | A-1701081.1 | 1389 | UGCUACUGUTUAUCCGUAAUA | 3482-3502 | A-1800413.1 | 1519 | UAUUACGGAUAAACAGUAGCACC | 3480-3502 |
| AD-953514.1 | A-1701089.1 | 1390 | ACUUUUCGUCCAACUUCUGGA | 657-677 | A-1800417.1 | 1520 | UCCAGAAGUUGGACGAAAAGUUU | 655-677 |

TABLE 4B-continued

| Exemplary Human VEGF-A siRNA Unmodified Single Strands and Duplex Sequences | | | | | | | | |
|---|---|---|---|---|---|---|---|---|
| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
| AD-953508.1 | A-1701077.1 | 1391 | GGUGCUACTGUUUAUCCGUAA | 3480-3500 | A-1800411.1 | 1521 | UTACGGAUAAACAGUAGCACCAA | 3478-3500 |
| AD-953531.1 | A-1701123.1 | 1392 | GCAAAAACACAGACUCGCGUA | 1655-1675 | A-1800434.1 | 1522 | UACGCGAGUCUGUGUTUUUGCAG | 1653-1675 |
| AD-953427.1 | A-1700915.1 | 1393 | CGUCGCACTGAAACUUUUCGA | 645-665 | A-1800330.1 | 1523 | UCGAAAAGUUUCAGUGCGACGCC | 643-665 |
| AD-953512.1 | A-1701085.1 | 1394 | AUAUUAACAUCACGUCUUUGA | 3517-3537 | A-1800415.1 | 1524 | UCAAAGACGUGAUGUTAAUAUCU | 3515-3537 |
| AD-953533.1 | A-1701127.1 | 1395 | AAAACACAGACUCGCGUUGCA | 1658-1678 | A-1800436.1 | 1525 | UGCAACGCGAGTCTGTGUUUUUG | 1656-1678 |
| AD-953464.1 | A-1700989.1 | 1396 | CUUGCAGATGTGACAAGCCGA | 1709-1729 | A-1800367.1 | 1526 | UCGGCUTGUCACATCTGCAAGUA | 1707-1729 |
| AD-953542.1 | A-1701145.1 | 1397 | UUUUUUUUCAGUAUUCUUGGA | 3027-3047 | A-1800445.1 | 1527 | UCCAAGAAUACTGAAAAAAAACC | 3025-3047 |
| AD-953426.1 | A-1700913.1 | 1398 | AAAGUGAGTGACCUGCUUUUA | 415-435 | A-1800329.1 | 1528 | UAAAAGCAGGUCACUCACUUUGC | 413-435 |
| AD-953515.1 | A-1701091.1 | 1399 | UUCGUCCAACTUCUGGGCUGA | 661-681 | A-1800418.1 | 1529 | UCAGCCCAGAAGUTGGACGAAAA | 659-681 |
| AD-953487.1 | A-1701035.1 | 1400 | AGGACAUUGCTGUGCUUUGGA | 2518-2538 | A-1800390.1 | 1530 | UCCAAAGCACAGCAATGUCCUGA | 2516-2538 |
| AD-953521.1 | A-1701103.1 | 1401 | AAAUCAGUTCGAGGAAAGGGA | 1462-1482 | A-1800424.1 | 1531 | UCCCTUTCCUCGAACTGAUUUUU | 1460-1482 |
| AD-953425.1 | A-1700911.1 | 1402 | UUCCCCAAAUCACUGUGGAUA | 278-298 | A-1800328.1 | 1532 | UAUCCACAGUGAUTUGGGGAAGU | 276-298 |
| AD-953536.1 | A-1701133.1 | 1403 | CCCUCUUGGAAUUGGAUUCGA | 1978-1998 | A-1800439.1 | 1533 | UCGAAUCCAAUTCCAAGAGGGAC | 1976-1998 |
| AD-953465.1 | A-1700991.1 | 1404 | UUGCAGAUGUGACAAGCCGAA | 1710-1730 | A-1800368.1 | 1534 | UTCGGCTUGUCACAUCUGCAAGU | 1708-1730 |
| AD-953552.1 | A-1701165.1 | 1405 | CACGUCUUTGTCUCUAGUGCA | 3527-3547 | A-1800455.1 | 1535 | UGCACUAGAGACAAAGACGUGAU | 3525-3547 |
| AD-953528.1 | A-1701117.1 | 1406 | GAUCCGCAGACGUGUAAAUGA | 1630-1650 | A-1800431.1 | 1536 | UCAUTUACACGTCTGCGGAUCUU | 1628-1650 |
| AD-953519.1 | A-1701099.1 | 1407 | AAAAAUCAGUTCGAGGAAAGA | 1460-1480 | A-1800422.1 | 1537 | UCUUTCCUCGAACTGAUUUUUUU | 1458-1480 |
| AD-953486.1 | A-1701033.1 | 1408 | UGCUGUGGACTUGAGUUGGGA | 2221-2241 | A-1800389.1 | 1538 | UCCCAACUCAAGUCCACAGCAGU | 2219-2241 |

TABLE 4B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-953522.1 | A-1701105.1 | 1409 | AAGGGGCAAAAACGAAAGCGA | 1483-1503 | A-1800425.1 | 1539 | UCGCTUTCGUUTUTGCCCCUUUC | 1481-1503 |
| AD-953530.1 | A-1701121.1 | 1410 | UGCAAAAACACAGACUCGCGA | 1654-1674 | A-1800433.1 | 1540 | UCGCGAGUCUGTGTUTUUGCAGG | 1652-1674 |
| AD-953513.1 | A-1701087.1 | 1411 | ACGUCUUUGUCUCUAGUGCAA | 3528-3548 | A-1800416.1 | 1541 | UTGCACTAGAGACAAAGACGUGA | 3526-3548 |
| AD-953441.1 | A-1700943.1 | 1412 | GGGCAAAAACGAAAGCGCAAA | 1486-1506 | A-1800344.1 | 1542 | UTUGCGCUUUCGUTUTUGCCCCU | 1484-1506 |
| AD-953440.1 | A-1700941.1 | 1413 | AGGGGCAAAAACGAAAGCGCA | 1484-1504 | A-1800343.1 | 1543 | UGCGCUTUCGUTUTUGCCCCUUU | 1482-1504 |
| AD-953518.1 | A-1701097.1 | 1414 | GAAAAAAAAUCAGUUCGAGGA | 1456-1476 | A-1800421.1 | 1544 | UCCUCGAACUGAUTUTUUUUCUU | 1454-1476 |
| AD-953520.1 | A-1701101.1 | 1415 | AAAAUCAGUUCGAGGAAAGGA | 1461-1481 | A-1800423.1 | 1545 | UCCUTUCCUCGAACUGAUUUUUU | 1459-1481 |
| AD-953532.1 | A-1701125.1 | 1416 | AAAAACACAGACUCGCGUUGA | 1657-1677 | A-1800435.1 | 1546 | UCAACGCGAGUCUGUGUUUUUGC | 1655-1677 |
| AD-953548.1 | A-1701157.1 | 1417 | UUUAUCCGTAAUAAUUGUGGA | 3490-3510 | A-1800451.1 | 1547 | UCCACAAUUAUTACGGAUAAACA | 3488-3510 |
| AD-953527.1 | A-1701115.1 | 1418 | AGAUCCGCAGACGUGUAAAUA | 1629-1649 | A-1800430.1 | 1548 | UAUUTACACGUCUGCGGAUCUUG | 1627-1649 |
| AD-953551.1 | A-1701163.1 | 1419 | UUAACAUCACGUCUUUGUCUA | 3520-3540 | A-1800454.1 | 1549 | UAGACAAAGACGUGATGUUAAUA | 3518-3540 |
| AD-953553.1 | A-1701167.1 | 1420 | CGUCUUUGTCTCUAGUGCAGA | 3529-3549 | A-1800456.1 | 1550 | UCUGCACUAGAGACAAAGACGUG | 3527-3549 |
| AD-953547.1 | A-1701155.1 | 1421 | GUUUAUCCGUAAUAAUUGUGA | 3489-3509 | A-1800450.1 | 1551 | UCACAAUTAUUACGGAUAAACAG | 3487-3509 |
| AD-953526.1 | A-1701113.1 | 1422 | UUGUUUGUACAAGAUCCGCAA | 1618-1638 | A-1800429.1 | 1552 | UTGCGGAUCUUGUACAAACAAAU | 1616-1638 |
| AD-953549.1 | A-1701159.1 | 1423 | UUAUCCGUAATAAUUGUGGGA | 3491-3511 | A-1800452.1 | 1553 | UCCCACAAUUATUACGGAUAAAC | 3489-3511 |
| AD-953534.1 | A-1701129.1 | 1424 | AACACAGACUCGCGUUGCAAA | 1660-1680 | A-1800437.1 | 1554 | UTUGCAACGCGAGTCTGUGUUUU | 1658-1680 |
| AD-953543.1 | A-1701147.1 | 1425 | UUUUUUUCAGTAUUCUUGGUA | 3028-3048 | A-1800446.1 | 1555 | UACCAAGAAUACUGAAAAAAAAC | 3026-3048 |
| AD-953550.1 | A-1701161.1 | 1426 | AUUAACAUCACGUCUUUGUCA | 3519-3539 | A-1800453.1 | 1556 | UGACAAAGACGTGAUGUUAAUAU | 3517-3539 |

TABLE 5A

Exemplary Rat VEGF-A siRNA Modified Single Strands and Duplex Sequences. The mRNA target sequence refers to the target sequence in rat; the corresponding human target sequence may differ.

| Duplex Name | Sense Oligo Name | SEQ ID NO: (Sense) | Sense Sequence | Antisense Oligo Name | SEQ ID NO: (Antisense) | Antisense Sequence | mRNA target sequence | SEQ ID NO: (mRNA target) |
|---|---|---|---|---|---|---|---|---|
| AD-579911.1 | A-1110768.1 | 1557 | csgsgaa(Ahd)CfuUfUfUfcguccaacsusa | A-1100967.1 | 1644 | VPusAfsguuGfgAfCfgaaaAfgUfuuccgsusg | CACGGAAACUUUUCGUCCAACUU | 4613 |
| AD-579912.1 | A-1110769.1 | 1558 | gsgsaaa(Chd)UfuUfUfCfguccaacususa | A-1100969.1 | 1645 | VPusAfsaguUfgGfAfcgaaAfaGfuuuccsgsu | ACGGAAACUUUUCGUCCAACUUC | 4614 |
| AD-579913.1 | A-1110770.1 | 1559 | csgsaca(Ghd)AfaCfAfGfuccuuaauscsa | A-1102172.1 | 1646 | VPusGfsauuAfaGfGfacugUfuCfugucgsasc | GUCGACAGAACAGUCCUUAAUCC | 4615 |
| AD-579914.1 | A-1110771.1 | 1560 | csusgcu(Ahd)AfuGfUfUfauugguguscsa | A-1102638.1 | 1647 | VPusGfsacaCfcAfAfuaacAfuUfagcagsasg | CUCUGCUAAUGUUAUUGGUGUCU | 4616 |
| AD-579915.1 | A-1110772.1 | 1561 | uscscga(Ghd)AfuAfUfUfccguaguascsa | A-1103944.1 | 1648 | VPusGfsuacUfaCfGfgaauAfuCfucggasasa | UUUCCGAGAUAUUCCGUAGUACA | 4617 |
| AD-579916.1 | A-1110773.1 | 1562 | csgsaga(Uhd)AfuUfCfCfguaguacasusa | A-1103888.1 | 1649 | VPusAfsuguAfcUfAfcggaAfuAfucucgsgsa | UCCGAGAUAUUCCGUAGUACAUA | 4618 |
| AD-579917.1 | A-1110774.1 | 1563 | gscsacg(Ghd)AfaAfCfUfuuucguccsasa | A-1100961.1 | 1650 | VPusUfsggaCfgAfAfaaguUfuCfcgugcsasa | UUGCACGGAAACUUUUCGUCCAA | 4619 |
| AD-579918.1 | A-1110775.1 | 1564 | csascgg(Ahd)AfaCfUfUfuucguccasasa | A-1100963.1 | 1651 | VPusUfsuggAfcGfAfaaagUfuUfccgugscsa | UGCACGGAAACUUUUCGUCCAAC | 4620 |
| AD-579919.1 | A-1110776.1 | 1565 | gsasgau(Ahd)UfuCfCfGfuaguacausasa | A-1103889.1 | 1652 | VPusUfsaugUfaCfUfacggAfaUfaucucsgsg | CCGAGAUAUUCCGUAGUACAUAU | 4621 |
| AD-579921.1 | A-1110778.1 | 1566 | ususguu(Uhd)GfuCfCfAfagauccgcsasa | A-1101976.1 | 1653 | VPusUfsgcgGfaUfCfuuggAfcAfaacaasasu | AUUUGUUUGUCCAAGAUCCGCAG | 4622 |
| AD-579922.1 | A-1110779.1 | 1567 | ascsgga(Ahd)AfcUfUfUfucguccaascsa | A-1100965.1 | 1654 | VPusGfsuugGfaCfGfaaaaGfuUfuccgusgsc | GCACGGAAACUUUUCGUCCAACU | 4623 |

TABLE 5A-continued

Exemplary Rat VEGF-A siRNA Modified Single Strands and Duplex Sequences. The mRNA target sequence refers to the target sequence in rat; the corresponding human target sequence may differ.

| Duplex Name | Sense Oligo Name | SEQ ID NO: (Sense) | Sense Sequence | Antisense Oligo Name | SEQ ID NO: (Antisense) | Antisense Sequence | mRNA target sequence | SEQ ID NO: (mRNA target) |
|---|---|---|---|---|---|---|---|---|
| AD-579923.1 | A-1110780.1 | 1568 | asuscau(Ghd)CfgGfAfUfcaaaccucsasa | A-1101742.1 | 1655 | VPusUfsgagGfuUfUfgaucCfgCfaugauscsu | AGAUCAUGCGGAUCAAACCUCAC | 4624 |
| AD-579924.1 | A-1110781.1 | 1569 | asusgcg(Ghd)AfuCfAfAfaccucaccsasa | A-1101659.1 | 1656 | VPusUfsgguGfaGfGfuuugAfuCfcgcausgsa | UCAUGCGGAUCAAACCUCACCAA | 4625 |
| AD-579925.1 | A-1110782.1 | 1570 | gsasuca(Uhd)GfcGfGfAfucaaaccuscsa | A-1101740.1 | 1657 | VPusGfsaggUfuUfGfauccGfcAfugaucsusg | CAGAUCAUGCGGAUCAAACCUCA | 4626 |
| AD-579926.1 | A-1110783.1 | 1571 | ususugu(Uhd)UfgUfCfCfaagauccgscsa | A-1101974.1 | 1658 | VPusGfscggAfuCfUfuggaCfaAfacaaasusg | CAUUUGUUUGUCCAAGAUCCGCA | 4627 |
| AD-579927.1 | A-1110784.1 | 1572 | gsasucg(Ghd)UfgAfCfAfgucacuagscsa | A-1103783.1 | 1659 | VPusGfscuaGfuGfAfcuguCfaCfcgaucsusg | CAGAUCGGUGACAGUCACUAGCU | 4628 |
| AD-579929.1 | A-1110786.1 | 1573 | asasgau(Chd)CfgCfAfGfacguguaasasa | A-1101968.1 | 1660 | VPusUfsuuaCfaCfGfucugCfgGfaucuusgsg | CCAAGAUCCGCAGACGUGUAAAU | 4629 |
| AD-579930.1 | A-1110787.1 | 1574 | usgsucc(Ahd)AfgAfUfCfcgcagacgsusa | A-1101986.1 | 1661 | VPusAfscguCfuGfCfggauCfuUfggacasasa | UUUGUCCAAGAUCCGCAGACGUG | 4630 |
| AD-579931.1 | A-1110788.1 | 1575 | asuscac(Ghd)UfcUfUfUfgucucuagsasa | A-1103887.1 | 1662 | VPusUfscuaGfaGfAfcaaaGfaCfgugausgsu | ACAUCACGUCUUUGUCUCUAGAG | 4631 |
| AD-579932.1 | A-1110789.1 | 1576 | usgsaaa(Chd)CfaUfGfAfacuuucugscsa | A-1101283.1 | 1663 | VPusGfscagAfaAfGfuucaUfgGfuuucasgsa | UCUGAAACCAUGAACUUUCUGCU | 4632 |
| AD-579933.1 | A-1110790.1 | 1577 | ususguc(Uhd)CfuAfGfAfgcaguuuuscsa | A-1103908.1 | 1664 | VPusGfsaaaAfcUfGfcucuAfgAfgacaasasg | CUUUGUCUCUAGAGCAGUUUUCC | 4633 |
| AD-579934.1 | A-1110791.1 | 1578 | csascuu(Chd)CfaGfAfAfacacgacasasa | A-1102962.1 | 1665 | VPusUfsuguCfgUfGfuuucUfgGfaagugsasg | CUCACUUCCAGAAACACGACAAA | 4634 |

TABLE 5A-continued

Exemplary Rat VEGF-A siRNA Modified Single Strands and Duplex Sequences. The mRNA target sequence refers to the target sequence in rat; the corresponding human target sequence may differ.

| Duplex Name | Sense Oligo Name | SEQ ID NO: (Sense) | Sense Sequence | Antisense Oligo Name | SEQ ID NO: (Antisense) | Antisense Sequence | mRNA target sequence | SEQ ID NO: (mRNA target) |
|---|---|---|---|---|---|---|---|---|
| AD-579935.1 | A-1110792.1 | 1579 | usgsaaa(Uhd)CfuGfUfGfuuuccaauscsa | A-1103728.1 | 1666 | VPusGfsauuGfgAfAfacacAfgAfuuucasusa | UAUGAAAUCUGUGUUUCCAAUCU | 4635 |
| AD-579936.1 | A-1110793.1 | 1580 | gsasaau(Chd)UfgUfGfUfuuccaaucsusa | A-1103730.1 | 1667 | VPusAfsgauUfgGfAfaacaCfaGfauuucsasu | AUGAAAUCUGUGUUUCCAAUCUC | 4636 |
| AD-579937.1 | A-1110794.1 | 1581 | ususugu(Chd)UfcUfAfGfagcaguuusUsa | A-1103906.1 | 1668 | VPusAfsaaaCfuGfCfucuaGfaGfacaaasgsa | UCUUUGUCUCUAGAGCAGUUUUC | 4637 |
| AD-579938.1 | A-1110795.1 | 1582 | usgsucu(Chd)UfaGfAfGfcaguuuucscsa | A-1103910.1 | 1669 | VPusGfsgaaAfaCfUfgcucUfaGfagacasasa | UUUGUCUCUAGAGCAGUUUUCCG | 4638 |
| AD-579939.1 | A-1110796.1 | 1583 | asascug(Uhd)AfuUfGfUfuuuacgcusUsa | A-1100541.1 | 1670 | VPusAfsagcGfuAfAfaacaAfuAfcaguusUsa | UAAACUGUAUUGUUUUACGCUUU | 4639 |
| AD-579940.1 | A-1110797.1 | 1584 | ascsugu(Ahd)UfuGfUfUfuuacgcuusUsa | A-1100543.1 | 1671 | VPusAfsaagCfgUfAfaaacAfaUfacagususu | AAACUGUAUUGUUUUACGCUUUA | 4640 |
| AD-579941.1 | A-1110798.1 | 1585 | csusgua(Uhd)UfgUfUfUfuacgcuuusasa | A-1100545.1 | 1672 | VPusUfsaaaGfcGfUfaaaaCfaAfuacagsusu | AACUGUAUUGUUUUACGCUUUAA | 4641 |
| AD-579942.1 | A-1110799.1 | 1586 | usgsuau(Uhd)GfuUfUfUfacgcuuuasasa | A-1100547.1 | 1673 | VPusUfsuaaAfgCfGfuaaaAfcAfauacasgsu | ACUGUAUUGUUUUACGCUUUAAU | 4642 |
| AD-579943.1 | A-1110800.1 | 1587 | asusuga(Ahd)AfcCfAfCfuaauucugsusa | A-1103504.1 | 1674 | VPusAfscagAfaUfUfagugGfuUfucaausgsg | CCAUUGAAACCACUAAUUCUGUC | 4643 |
| AD-579944.1 | A-1110801.1 | 1588 | ascsuua(Uhd)UfuAfAfUfagcccuuusUsa | A-1103594.1 | 1675 | VPusAfsaaaGfgGfCfuauuAfaAfuaagusasc | GUACUUAUUUAAUAGCCCUUUUU | 4644 |
| AD-579945.1 | A-1110802.1 | 1589 | uscsucu(Ahd)GfaGfCfAfguuuuccgsasa | A-1103914.1 | 1676 | VPusUfscggAfaAfAfcugcUfcUfagagascsa | UGUCUCUAGAGCAGUUUUCCGAG | 4645 |

TABLE 5A-continued

Exemplary Rat VEGF-A siRNA Modified Single Strands and Duplex Sequences. The mRNA target sequence refers to the target sequence in rat; the corresponding human target sequence may differ.

| Duplex Name | Sense Oligo Name | SEQ ID NO: (Sense) | Sense Sequence | Antisense Oligo Name | SEQ ID NO: (Antisense) | Antisense Sequence | mRNA target sequence | SEQ ID NO: (mRNA target) |
|---|---|---|---|---|---|---|---|---|
| AD-579946.1 | A-1110803.1 | 1590 | cscsgag(Ahd)UfaUfUfCfcguaguacsasa | A-1103946.1 | 1677 | VPusUfsguaCfuAfCfggaaUfaUfcucggsasa | UUCCGAGAUAUUCCGUAGUACAU | 4646 |
| AD-579947.1 | A-1110804.1 | 1591 | uscsugg(Ghd)AfuUfUfGfauauucaasasa | A-1100511.1 | 1678 | VPusUfsuugAfaUfAfucaaAfuCfccagasgsc | GCUCUGGGAUUUGAUAUUCAAAC | 4647 |
| AD-579948.1 | A-1110805.1 | 1592 | ususcac(Uhd)GfgAfUfAfuguuugacsusa | A-1102658.1 | 1679 | VPusAfsgucAfaAfCfauauCfcAfgugaasgsa | UCUUCACUGGAUAUGUUUGACUG | 4648 |
| AD-579949.1 | A-1110806.1 | 1593 | gsgscuc(Ahd)CfuUfCfCfagaaacacsgsa | A-1102954.1 | 1680 | VPusCfsgugUfuUfCfuggaAfgUfgagccsasa | UUGGCUCACUUCCAGAAACACGA | 4649 |
| AD-579950.1 | A-1110807.1 | 1594 | csusucc(Ahd)GfaAfAfCfacgacaaascsa | A-1102966.1 | 1681 | VPusGfsuuuGfuCfGfuguuUfcUfggaagsusg | CACUUCCAGAAACACGACAAACC | 4650 |
| AD-579951.1 | A-1110808.1 | 1595 | gsascca(Uhd)UfgAfAfAfccacuaaususa | A-1103496.1 | 1682 | VPusAfsauuAfgUfGfguuuCfaAfuggucsusg | CAGACCAUUGAAACCACUAAUUC | 4651 |
| AD-579953.1 | A-1110810.1 | 1596 | asgsuca(Chd)UfaGfCfUfuguccugasgsa | A-1103805.1 | 1683 | VPusCfsucaGfgAfCfaagcUfaGfugacusgsu | ACAGUCACUAGCUUGUCCUGAGA | 4652 |
| AD-579954.1 | A-1110811.1 | 1597 | ascscac(Ahd)CfaUfUfCfcuuugaaasusa | A-1103837.1 | 1684 | VPusAfsuuuCfaAfAfggaaUfgUfguggusgsg | CCACCACACAUUCCUUUGAAAUA | 4653 |
| AD-579955.1 | A-1110812.1 | 1598 | ascscgg(Ahd)AfaGfAfCfcgauuaacscsa | A-1102128.1 | 1685 | VPusGfsguuAfaUfCfggucUfuUfccggusgsa | UCACCGGAAAGACCGAUUAACCA | 4654 |
| AD-579956.1 | A-1110813.1 | 1599 | asgsacc(Ghd)AfuUfAfAfccaugucascsa | A-1102142.1 | 1686 | VPusGfsugaCfaUfGfguuaAfuCfggucususu | AAAGACCGAUUAACCAUGUCACC | 4655 |
| AD-579957.1 | A-1110814.1 | 1600 | csusuca(Chd)UfgGfAfUfauguuugascsa | A-1102656.1 | 1687 | VPusGfsucaAfaCfAfuaucCfaGfugaagsasc | GUCUUCACUGGAUAUGUUUGACU | 4656 |

TABLE 5A-continued

Exemplary Rat VEGF-A siRNA Modified Single Strands and Duplex Sequences. The mRNA target sequence refers to the target sequence in rat; the corresponding human target sequence may differ.

| Duplex Name | Sense Oligo Name | SEQ ID NO: (Sense) | Sense Sequence | Antisense Oligo Name | SEQ ID NO: (Antisense) | Antisense Sequence | mRNA target sequence | SEQ ID NO: (mRNA target) |
|---|---|---|---|---|---|---|---|---|
| AD-579958.1 | A-1110815.1 | 1601 | ususggc(Uhd)CfaCfUfUfccagaaacsasa | A-1102950.1 | 1688 | VPusUfsguuUfcUfGfgaagUfgAfgccaascsg | CGUUGGCUCACUUCCAGAAACAC | 4657 |
| AD-579959.1 | A-1110816.1 | 1602 | csuscac(Uhd)UfcCfAfGfaaacacgascsa | A-1102958.1 | 1689 | VPusGfsucgUfgUfUfucugGfaAfgugagscsc | GGCUCACUUCCAGAAACACGACA | 4658 |
| AD-579960.1 | A-1110817.1 | 1603 | gsusgac(Ahd)GfuCfAfCfuagcuuguscsa | A-1103795.1 | 1690 | VPusGfsacaAfgCfUfagugAfcUfgucacscsg | CGGUGACAGUCACUAGCUUGUCC | 4659 |
| AD-579961.1 | A-1110818.1 | 1604 | gsuscuc(Uhd)AfgAfGfCfaguuuuccsgsa | A-1103912.1 | 1691 | VPusCfsggaAfaAfCfugcuCfuAfgagacsasa | UUGUCUCUAGAGCAGUUUUCCGA | 4660 |
| AD-579962.1 | A-1110819.1 | 1605 | csuscua(Ghd)AfgCfAfGfuuuuccgasgsa | A-1103916.1 | 1692 | VPusCfsucgGfaAfAfacugCfuCfuagagsasc | GUCUCUAGAGCAGUUUUCCGAGA | 4661 |
| AD-579963.1 | A-1110820.1 | 1606 | gsusuuu(Chd)CfgAfGfAfuauuccgusasa | A-1103936.1 | 1693 | VPusUfsacgGfaAfUfaucuCfgGfaaaacsusg | CAGUUUUCCGAGAUAUUCCGUAG | 4662 |
| AD-579964.1 | A-1110821.1 | 1607 | ususccg(Ahd)GfaUfAfUfuccguagusasa | A-1103942.1 | 1694 | VPusUfsacuAfcGfGfaauaUfcUfcggaasasa | UUUUCCGAGAUAUUCCGUAGUAC | 4663 |
| AD-579965.1 | A-1110822.1 | 1608 | ususaaa(Chd)UfgUfAfUfuguuuuacsgsa | A-1100535.1 | 1695 | VPusCfsguaAfaAfCfaauaCfaGfuuuaasgsa | UCUUAAACUGUAUUGUUUUACGC | 4664 |
| AD-579966.1 | A-1110823.1 | 1609 | asasacu(Ghd)UfaUfUfGfuuuuacgcsusa | A-1100539.1 | 1696 | VPusAfsgcgUfaAfAfacaaUfaCfaguuusasa | UUAAACUGUAUUGUUUUACGCUU | 4665 |
| AD-579967.1 | A-1110824.1 | 1610 | gsasuuc(Ghd)CfcAfUfUfuucuuauasusa | A-1102468.1 | 1697 | VPusAfsuauAfaGfAfaaauGfgCfgaaucscsa | UGGAUUCGCCAUUUUCUUAUAUU | 4666 |
| AD-579968.1 | A-1110825.1 | 1611 | uscsacu(Ghd)GfaUfAfUfguuugacusgsa | A-1102660.1 | 1698 | VPusCfsaguCfaAfAfcauaUfcCfagugasasg | CUUCACUGGAUAUGUUUGACUGC | 4667 |

TABLE 5A-continued

Exemplary Rat VEGF-A siRNA Modified Single Strands and Duplex Sequences. The mRNA target sequence refers to the target sequence in rat; the corresponding human target sequence may differ.

| Duplex Name | Sense Oligo Name | SEQ ID NO: (Sense) | Sense Sequence | Antisense Oligo Name | SEQ ID NO: (Antisense) | Antisense Sequence | mRNA target sequence | SEQ ID NO: (mRNA target) |
|---|---|---|---|---|---|---|---|---|
| AD-579969.1 | A-1110826.1 | 1612 | gsusugg(Chd)UfcAfCfUfuccagaaascsa | A-1102948.1 | 1699 | VPusGfsuuuCfuGfGfaaguGfaGfccaacsgsu | ACGUUGGCUCACUUCCAGAAACA | 4668 |
| AD-579970.1 | A-1110827.1 | 1613 | ascsuuc(Chd)AfgAfAfAfcacgacaasasa | A-1102964.1 | 1700 | VPusUfsuugUfcGfUfguuuCfuGfgaagusgsa | UCACUUCCAGAAACACGACAAAC | 4669 |
| AD-579971.1 | A-1110828.1 | 1614 | usascuu(Ahd)UfuUfAfAfuagcccuususa | A-1103592.1 | 1701 | VPusAfsaagGfgCfUfauuaAfaUfaaguascsc | GGUACUUAUUUAAUAGCCCUUUU | 4670 |
| AD-579972.1 | A-1110829.1 | 1615 | asgsagc(Ahd)GfuUfUfUfccgagauasusa | A-1103924.1 | 1702 | VPusAfsuauCfuCfGfgaaaAfcUfgcucusasg | CUAGAGCAGUUUUCCGAGAUAUU | 4671 |
| AD-579973.1 | A-1110830.1 | 1616 | usgsgga(Uhd)UfuGfAfUfauucaaacscsa | A-1100515.1 | 1703 | VPusGfsguuUfgAfAfuaucAfaAfucccasgsa | UCUGGGAUUUGAUAUUCAAACCU | 4672 |
| AD-579974.1 | A-1110831.1 | 1617 | gsgsgau(Uhd)UfgAfUfAfuucaaaccsusa | A-1100517.1 | 1704 | VPusAfsgguUfuGfAfauauCfaAfaucccsasg | CUGGGAUUUGAUAUUCAAACCUC | 4673 |
| AD-579975.1 | A-1110832.1 | 1618 | gsasuuu(Ghd)AfuAfUfUfcaaaccucsusa | A-1100521.1 | 1705 | VPusAfsgagGfuUfUfgaauAfuCfaaaucscsc | GGGAUUUGAUAUUCAAACCUCUU | 4674 |
| AD-579976.1 | A-1110833.1 | 1619 | usasaac(Uhd)GfuAfUfUfguuuuacgscsa | A-1100537.1 | 1706 | VPusGfscguAfaAfAfcaauAfcAfguuuasasg | CUUAAACUGUAUUGUUUUACGCU | 4675 |
| AD-579977.1 | A-1110834.1 | 1620 | uscsacc(Ghd)GfaAfAfGfaccgauuasasa | A-1102124.1 | 1707 | VPusUfsuaaUfcGfGfucuuUfcCfggugasgsa | UCUCACCGGAAAGACCGAUUAAC | 4676 |
| AD-579978.1 | A-1110835.1 | 1621 | csasccg(Ghd)AfaAfGfAfccgauuaascsa | A-1102126.1 | 1708 | VPusGfsuuaAfuCfGfgucuUfuCfcggugsasg | CUCACCGGAAAGACCGAUUAACC | 4677 |
| AD-579979.1 | A-1110836.1 | 1622 | cscsgga(Ahd)AfgAfCfCfgauuaaccsasa | A-1102130.1 | 1709 | VPusUfsgguUfaAfUfcgguCfuUfuccggsusg | CACCGGAAAGACCGAUUAACCAU | 4678 |

TABLE 5A-continued

Exemplary Rat VEGF-A siRNA Modified Single Strands and Duplex Sequences. The mRNA target sequence refers to the target sequence in rat; the corresponding human target sequence may differ.

| Duplex Name | Sense Oligo Name | SEQ ID NO: (Sense) | Sense Sequence | Antisense Oligo Name | SEQ ID NO: (Antisense) | Antisense Sequence | mRNA target sequence | SEQ ID NO: (mRNA target) |
|---|---|---|---|---|---|---|---|---|
| AD-579980.1 | A-1110837.1 | 1623 | gsasacu(Ghd)GfaUfUfCfgccauuuuscsa | A-1102456.1 | 1710 | VPusGfsaaaAfuGfGfcgaaUfcCfaguucscsa | UGGAACUGGAUUCGCCAUUUUCU | 4679 |
| AD-579981.1 | A-1110838.1 | 1624 | csascug(Ghd)AfuAfUfGfuuugacugscsa | A-1102662.1 | 1711 | VPusGfscagUfcAfAfacauAfuCfcagugsasa | UUCACUGGAUAUGUUUGACUGCU | 4680 |
| AD-579982.1 | A-1110839.1 | 1625 | gsgsacc(Uhd)UfgUfGfUfgaucagacscsa | A-1103464.1 | 1712 | VPusGfsgucUfgAfUfcacaCfaAfgguccsusc | GAGGACCUUGUGUGAUCAGACCA | 4681 |
| AD-579983.1 | A-1110840.1 | 1626 | uscsaga(Chd)CfaUfUfGfaaaccacusasa | A-1103490.1 | 1713 | VPusUfsaguGfgUfUfucaaUfgGfucugasusc | GAUCAGACCAUUGAAACCACUAA | 4682 |
| AD-579984.1 | A-1110841.1 | 1627 | csasuug(Ahd)AfaCfCfAfcuaauucusgsa | A-1103502.1 | 1714 | VPusCfsagaAfuUfAfguggUfuUfcaaugsgsu | ACCAUUGAAACCACUAAUUCUGU | 4683 |
| AD-579985.1 | A-1110842.1 | 1628 | csusaga(Ghd)CfaGfUfUfuuccgagasusa | A-1103920.1 | 1715 | VPusAfsucuCfgGfAfaaacUfgCfucuagsasg | CUCUAGAGCAGUUUUCCGAGAUA | 4684 |
| AD-579986.1 | A-1110843.1 | 1629 | usasgag(Chd)AfgUfUfUfuccgagausasa | A-1103922.1 | 1716 | VPusUfsaucUfcGfGfaaaaCfuGfcucuasgsa | UCUAGAGCAGUUUUCCGAGAUAU | 4685 |
| AD-579987.1 | A-1110844.1 | 1630 | asgsuuu(Uhd)CfcGfAfGfauauuccgsusa | A-1103934.1 | 1717 | VPusAfscggAfaUfAfucucGfgAfaaacusgsc | GCAGUUUUCCGAGAUAUUCCGUA | 4686 |
| AD-579988.1 | A-1110845.1 | 1631 | gscsgga(Uhd)CfaAfAfCfcucaccaasasa | A-1101748.1 | 1718 | VPusUfsuugGfuGfAfgguuUfgAfuccgcsasu | AUGCGGAUCAAACCUCACCAAAG | 4687 |
| AD-579989.1 | A-1110846.1 | 1632 | asgscau(Uhd)UfgUfUfUfguccaagasusa | A-1101962.1 | 1719 | VPusAfsucuUfgGfAfcaaaCfaAfaugcususu | AAAGCAUUUGUUUGUCCAAGAUC | 4688 |
| AD-579990.1 | A-1110847.1 | 1633 | uscsuca(Chd)CfgGfAfAfagaccgausasa | A-1102120.1 | 1720 | VPusAfsaucGfgUfCfuuucCfgGfugagasgsg | CCUCUCACCGGAAAGACCGAUUA | 4689 |

TABLE 5A-continued

Exemplary Rat VEGF-A siRNA Modified Single Strands and Duplex Sequences. The mRNA target sequence refers to the target sequence in rat; the corresponding human target sequence may differ.

| Duplex Name | Sense Oligo Name | SEQ ID NO: (Sense) | Sense Sequence | Antisense Oligo Name | SEQ ID NO: (Antisense) | Antisense Sequence | mRNA target sequence | SEQ ID NO: (mRNA target) |
|---|---|---|---|---|---|---|---|---|
| AD-579992.1 | A-1110849.1 | 1634 | uscsuag(Ahd)GfcAfGfUfuuuccgagsasa | A-1103918.1 | 1721 | VPusUfscucGfgAfAfaacuGfcUfcuagasgsa | UCUCUAGAGCAGUUUUCCGAGAU | 4690 |
| AD-579993.1 | A-1110850.1 | 1635 | asusugc(Ahd)CfgGfAfAfacuuuucgsusa | A-1100955.1 | 1722 | VPusAfscgaAfaAfGfuuucCfgUfgcaauscsc | GGAUUGCACGGAAACUUUUCGUC | 4691 |
| AD-579995.1 | A-1110852.1 | 1636 | gscsucu(Ghd)GfgAfUfUfugauauucsasa | A-1100507.1 | 1723 | VPusUfsgaaUfaUfCfaaauCfcCfagagcsasc | GUGCUCUGGGAUUUGAUAUUCAA | 4692 |
| AD-579996.1 | A-1110853.1 | 1637 | usgsagc(Chd)UfuGfUfUfcagagcggsasa | A-1101930.1 | 1724 | VPusUfsccgCfuCfUfgaacAfaGfgcucascsa | UGUGAGCCUUGUUCAGAGCGGAG | 4693 |
| AD-579997.1 | A-1110854.1 | 1638 | asgsccu(Uhd)GfuUfCfAfgagcggagsasa | A-1101934.1 | 1725 | VPusUfscucCfgCfUfcugaAfcAfaggcuscsa | UGAGCCUUGUUCAGAGCGGAGAA | 4694 |
| AD-579998.1 | A-1110855.1 | 1639 | csasuuu(Ghd)UfuUfGfUfccaagaucscsa | A-1101966.1 | 1726 | VPusGfsgauCfuUfGfgacaAfaCfaaaugscsu | AGCAUUUGUUUGUCCAAGAUCCG | 4695 |
| AD-579999.1 | A-1110856.1 | 1640 | gsgsaaa(Ghd)AfcCfGfAfuuaaccausgsa | A-1102134.1 | 1727 | VPusCfsaugGfuUfAfaucgGfuCfuuuccsgsg | CCGGAAAGACCGAUUAACCAUGU | 4696 |
| AD-580000.1 | A-1110857.1 | 1641 | gsasaag(Ahd)CfcGfAfUfuaaccaugsusa | A-1102136.1 | 1728 | VPusAfscauGfgUfUfaaucGfgUfcuuucscsg | CGGAAAGACCGAUUAACCAUGUC | 4697 |
| AD-580001.1 | A-1110858.1 | 1642 | asasgac(Chd)GfaUfUfAfaccaugucsasa | A-1102140.1 | 1729 | VPusUfsgacAfuGfGfuuaaUfcGfgucuususc | GAAAGACCGAUUAACCAUGUCAC | 4698 |
| AD-580002.1 | A-1110859.1 | 1643 | gsasccg(Ahd)UfuAfAfCfcaugucacscsa | A-1102144.1 | 1730 | VPusGfsgugAfcAfUfgguuAfaUfcggucsusu | AAGACCGAUUAACCAUGUCACCA | 4699 |

TABLE 5B

Exemplary Rat VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
|---|---|---|---|---|---|---|---|---|
| AD-579911.1 | A-1110768.1 | 1731 | CGGAAACUUUUCGUCCAACUA | 631-651 | A-1100967.1 | 1818 | UAGUUGGACGAAAAGUUUCCGUG | 629-651 |
| AD-579912.1 | A-1110769.1 | 1732 | GGAAACUUUUCGUCCAACUUA | 632-652 | A-1100969.1 | 1819 | UAAGUUGGACGAAAAGUUUCCGU | 630-652 |
| AD-579913.1 | A-1110770.1 | 1733 | CGACAGAACAGUCCUUAAUCA | 1689-1709 | A-1102172.1 | 1820 | UGAUUAAGGACUGUUCUGUCGAC | 1687-1709 |
| AD-579914.1 | A-1110771.1 | 1734 | CUGCUAAUGUUAUUGGUGUCA | 2020-2040 | A-1102638.1 | 1821 | UGACACCAAUAACAUUAGCAGAG | 2018-2040 |
| AD-579915.1 | A-1110772.1 | 1735 | UCCGAGAUAUUCCGUAGUACA | 3364-3384 | A-1103944.1 | 1822 | UGUACUACGGAAUAUCUCGGAAA | 3362-3384 |
| AD-579916.1 | A-1110773.1 | 1736 | CGAGAUAUUCCGUAGUACAUA | 3366-3386 | A-1103888.1 | 1823 | UAUGUACUACGGAAUAUCUCGGA | 3364-3386 |
| AD-579917.1 | A-1110774.1 | 1737 | GCACGGAAACUUUUCGUCCAA | 628-648 | A-1100961.1 | 1824 | UUGGACGAAAAGUUUCCGUGCAA | 626-648 |
| AD-579918.1 | A-1110775.1 | 1738 | CACGGAAACUUUUCGUCCAAA | 629-649 | A-1100963.1 | 1825 | UUUGGACGAAAAGUUUCCGUGCA | 627-649 |
| AD-579919.1 | A-1110776.1 | 1739 | GAGAUAUUCCGUAGUACAUAA | 3367-3387 | A-1103889.1 | 1826 | UUAUGUACUACGGAAUAUCUCGG | 3365-3387 |
| AD-579921.1 | A-1110778.1 | 1740 | UUGUUUGUCCAAGAUCCGCAA | 1468-1488 | A-1101976.1 | 1827 | UUGCGGAUCUUGGACAAACAAAU | 1466-1488 |
| AD-579922.1 | A-1110779.1 | 1741 | ACGGAAACUUUUCGUCCAACA | 630-650 | A-1100965.1 | 1828 | UGUUGGACGAAAAGUUUCCGUGC | 628-650 |
| AD-579923.1 | A-1110780.1 | 1742 | AUCAUGCGGAUCAAACCUCAA | 1327-1347 | A-1101742.1 | 1829 | UUGAGGUUUGAUCCGCAUGAUCU | 1325-1347 |
| AD-579924.1 | A-1110781.1 | 1743 | AUGCGGAUCAAACCUCACCAA | 1330-1350 | A-1101659.1 | 1830 | UUGGUGAGGUUUGAUCCGCAUGA | 1328-1350 |
| AD-579925.1 | A-1110782.1 | 1744 | GAUCAUGCGGAUCAAACCUCA | 1326-1346 | A-1101740.1 | 1831 | UGAGGUUUGAUCCGCAUGAUCUG | 1324-1346 |
| AD-579926.1 | A-1110783.1 | 1745 | UUUGUUUGUCCAAGAUCCGCA | 1467-1487 | A-1101974.1 | 1832 | UGCGGAUCUUGGACAAACAAAUG | 1465-1487 |
| AD-579927.1 | A-1110784.1 | 1746 | GAUCGGUGACAGUCACUAGCA | 2972-2992 | A-1103783.1 | 1833 | UGCUAGUGACUGUCACCGAUCUG | 2970-2992 |
| AD-579929.1 | A-1110786.1 | 1747 | AAGAUCCGCAGACGUGUAAAA | 1478-1498 | A-1101968.1 | 1834 | UUUUACACGUCUGCGGAUCUUGG | 1476-1498 |
| AD-579930.1 | A-1110787.1 | 1748 | UGUCCAAGAUCCGCAGACGUA | 1473-1493 | A-1101986.1 | 1835 | UACGUCUGCGGAUCUUGGACAAA | 1471-1493 |

TABLE 5B-continued

Exemplary Rat VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
|---|---|---|---|---|---|---|---|---|
| AD-579931.1 | A-1110788.1 | 1749 | AUCACGUCUUUGUCUCUAGAA | 3337-3357 | A-1103887.1 | 1836 | UUCUAGAGACAAAGACGUGAUGU | 3335-3357 |
| AD-579932.1 | A-1110789.1 | 1750 | UGAAACCAUGAACUUUCUGCA | 1008-1028 | A-1101283.1 | 1837 | UGCAGAAAGUUCAUGGUUUCAGA | 1006-1028 |
| AD-579933.1 | A-1110790.1 | 1751 | UUGUCUCUAGAGCAGUUUUCA | 3346-3366 | A-1103908.1 | 1838 | UGAAAACUGCUCUAGAGACAAAG | 3344-3366 |
| AD-579934.1 | A-1110791.1 | 1752 | CACUUCCAGAAACACGACAAA | 2222-2242 | A-1102962.1 | 1839 | UUUGUCGUGUUUCUGGAAGUGAG | 2220-2242 |
| AD-579935.1 | A-1110792.1 | 1753 | UGAAAUCUGUGUUUCCAAUCA | 2941-2961 | A-1103728.1 | 1840 | UGAUUGGAAACACAGAUUUCAUA | 2939-2961 |
| AD-579936.1 | A-1110793.1 | 1754 | GAAAUCUGUGUUUCCAAUCUA | 2942-2962 | A-1103730.1 | 1841 | UAGAUUGGAAACACAGAUUUCAU | 2940-2962 |
| AD-579937.1 | A-1110794.1 | 1755 | UUUGUCUCUAGAGCAGUUUUA | 3345-3365 | A-1103906.1 | 1842 | UAAAACUGCUCUAGAGACAAAGA | 3343-3365 |
| AD-579938.1 | A-1110795.1 | 1756 | UGUCUCUAGAGCAGUUUUCCA | 3347-3367 | A-1103910.1 | 1843 | UGGAAAACUGCUCUAGAGACAAA | 3345-3367 |
| AD-579939.1 | A-1110796.1 | 1757 | AACUGUAUUGUUUUACGCUUA | 167-187 | A-1100541.1 | 1844 | UAAGCGUAAAACAAUACAGUUUA | 165-187 |
| AD-579940.1 | A-1110797.1 | 1758 | ACUGUAUUGUUUUACGCUUUA | 168-188 | A-1100543.1 | 1845 | UAAAGCGUAAAACAAUACAGUUU | 166-188 |
| AD-579941.1 | A-1110798.1 | 1759 | CUGUAUUGUUUUACGCUUUAA | 169-189 | A-1100545.1 | 1846 | UUAAAGCGUAAAACAAUACAGUU | 167-189 |
| AD-579942.1 | A-1110799.1 | 1760 | UGUAUUGUUUUACGCUUUAAA | 170-190 | A-1100547.1 | 1847 | UUUAAAGCGUAAAACAAUACAGU | 168-190 |
| AD-579943.1 | A-1110800.1 | 1761 | AUUGAAACCACUAAUUCUGUA | 2611-2631 | A-1103504.1 | 1848 | UACAGAAUUAGUGGUUUCAAUGG | 2609-2631 |
| AD-579944.1 | A-1110801.1 | 1762 | ACUUAUUUAAUAGCCCUUUUA | 2764-2784 | A-1103594.1 | 1849 | UAAAAGGGCUAUUAAAUAAGUAC | 2762-2784 |
| AD-579945.1 | A-1110802.1 | 1763 | UCUCUAGAGCAGUUUUCCGAA | 3349-3369 | A-1103914.1 | 1850 | UUCGGAAAACUGCUCUAGAGACA | 3347-3369 |
| AD-579946.1 | A-1110803.1 | 1764 | CCGAGAUAUUCCGUAGUACAA | 3365-3385 | A-1103946.1 | 1851 | UUGUACUACGGAAUAUCUCGGAA | 3363-3385 |
| AD-579947.1 | A-1110804.1 | 1765 | UCUGGGAUUUGAUAUUCAAAA | 129-149 | A-1100511.1 | 1852 | UUUUGAAUAUCAAAUCCCAGAGC | 127-149 |
| AD-579948.1 | A-1110805.1 | 1766 | UUCACUGGAUAUGUUUGACUA | 2040-2060 | A-1102658.1 | 1853 | UAGUCAAACAUAUCCAGUGAAGA | 2038-2060 |

TABLE 5B-continued

Exemplary Rat VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
|---|---|---|---|---|---|---|---|---|
| AD-579949.1 | A-1110806.1 | 1767 | GGCUCACUUCCAGAAACACGA | 2218-2238 | A-1102954.1 | 1854 | UCGUGUUUCUGGAAGUGAGCCAA | 2216-2238 |
| AD-579950.1 | A-1110807.1 | 1768 | CUUCCAGAAACACGACAAACA | 2224-2244 | A-1102966.1 | 1855 | UGUUUGUCGUGUUUCUGGAAGUG | 2222-2244 |
| AD-579951.1 | A-1110808.1 | 1769 | GACCAUUGAAACCACUAAUUA | 2607-2627 | A-1103496.1 | 1856 | UAAUUAGUGGUUUCAAUGGUCUG | 2605-2627 |
| AD-579953.1 | A-1110810.1 | 1770 | AGUCACUAGCUUGUCCUGAGA | 2982-3002 | A-1103805.1 | 1857 | UCUCAGGACAAGCUAGUGACUGU | 2980-3002 |
| AD-579954.1 | A-1110811.1 | 1771 | ACCACACAUUCCUUUGAAAUA | 3049-3069 | A-1103837.1 | 1858 | UAUUUCAAAGGAAUGUGUGGUGG | 3047-3069 |
| AD-579955.1 | A-1110812.1 | 1772 | ACCGGAAAGACCGAUUAACCA | 1639-1659 | A-1102128.1 | 1859 | UGGUUAAUCGGUCUUUCCGGUGA | 1637-1659 |
| AD-579956.1 | A-1110813.1 | 1773 | AGACCGAUUAACCAUGUCACA | 1646-1666 | A-1102142.1 | 1860 | UGUGACAUGGUUAAUCGGUCUUU | 1644-1666 |
| AD-579957.1 | A-1110814.1 | 1774 | CUUCACUGGAUAUGUUUGACA | 2039-2059 | A-1102656.1 | 1861 | UGUCAAACAUAUCCAGUGAAGAC | 2037-2059 |
| AD-579958.1 | A-1110815.1 | 1775 | UUGGCUCACUUCCAGAAACAA | 2216-2236 | A-1102950.1 | 1862 | UUGUUUCUGGAAGUGAGCCAACG | 2214-2236 |
| AD-579959.1 | A-1110816.1 | 1776 | CUCACUUCCAGAAACACGACA | 2220-2240 | A-1102958.1 | 1863 | UGUCGUGUUUCUGGAAGUGAGCC | 2218-2240 |
| AD-579960.1 | A-1110817.1 | 1777 | GUGACAGUCACUAGCUUGUCA | 2977-2997 | A-1103795.1 | 1864 | UGACAAGCUAGUGACUGUCACCG | 2975-2997 |
| AD-579961.1 | A-1110818.1 | 1778 | GUCUCUAGAGCAGUUUUCCGA | 3348-3368 | A-1103912.1 | 1865 | UCGGAAAACUGCUCUAGAGACAA | 3346-3368 |
| AD-579962.1 | A-1110819.1 | 1779 | CUCUAGAGCAGUUUUCCGAGA | 3350-3370 | A-1103916.1 | 1866 | UCUCGGAAAACUGCUCUAGAGAC | 3348-3370 |
| AD-579963.1 | A-1110820.1 | 1780 | GUUUUCCGAGAUAUUCCGUAA | 3360-3380 | A-1103936.1 | 1867 | UUACGGAAUAUCUCGGAAAACUG | 3358-3380 |
| AD-579964.1 | A-1110821.1 | 1781 | UUCCGAGAUAUUCCGUAGUAA | 3363-3383 | A-1103942.1 | 1868 | UUACUACGGAAUAUCUCGGAAAA | 3361-3383 |
| AD-579965.1 | A-1110822.1 | 1782 | UUAAACUGUAUUGUUUUACGA | 164-184 | A-1100535.1 | 1869 | UCGUAAAACAAUACAGUUUAAGA | 162-184 |
| AD-579966.1 | A-1110823.1 | 1783 | AAACUGUAUUGUUUUACGCUA | 166-186 | A-1100539.1 | 1870 | UAGCGUAAAACAAUACAGUUUAA | 164-186 |
| AD-579967.1 | A-1110824.1 | 1784 | GAUUCGCCAUUUUCUUAUAUA | 1830-1850 | A-1102468.1 | 1871 | UAUAUAAGAAAAUGGCGAAUCCA | 1828-1850 |

TABLE 5B-continued

Exemplary Rat VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
|---|---|---|---|---|---|---|---|---|
| AD-579968.1 | A-1110825.1 | 1785 | UCACUGGAUAUGUUUGACUGA | 2041-2061 | A-1102660.1 | 1872 | UCAGUCAAACAUAUCCAGUGAAG | 2039-2061 |
| AD-579969.1 | A-1110826.1 | 1786 | GUUGGCUCACUUCCAGAAACA | 2215-2235 | A-1102948.1 | 1873 | UGUUUCUGGAAGUGAGCCAACGU | 2213-2235 |
| AD-579970.1 | A-1110827.1 | 1787 | ACUUCCAGAAACACGACAAAA | 2223-2243 | A-1102964.1 | 1874 | UUUUGUCGUGUUUCUGGAAGUGA | 2221-2243 |
| AD-579971.1 | A-1110828.1 | 1788 | UACUUAUUUAAUAGCCCUUUA | 2763-2783 | A-1103592.1 | 1875 | UAAAGGGCUAUUAAAUAAGUACC | 2761-2783 |
| AD-579972.1 | A-1110829.1 | 1789 | AGAGCAGUUUUCCGAGAUAUA | 3354-3374 | A-1103924.1 | 1876 | UAUAUCUCGGAAAACUGCUCUAG | 3352-3374 |
| AD-579973.1 | A-1110830.1 | 1790 | UGGGAUUUGAUAUUCAAACCA | 131-151 | A-1100515.1 | 1877 | UGGUUUGAAUAUCAAAUCCCAGA | 129-151 |
| AD-579974.1 | A-1110831.1 | 1791 | GGGAUUUGAUAUUCAAACCUA | 132-152 | A-1100517.1 | 1878 | UAGGUUUGAAUAUCAAAUCCCAG | 130-152 |
| AD-579975.1 | A-1110832.1 | 1792 | GAUUUGAUAUUCAAACCUCUA | 134-154 | A-1100521.1 | 1879 | UAGAGGUUUGAAUAUCAAAUCCC | 132-154 |
| AD-579976.1 | A-1110833.1 | 1793 | UAAACUGUAUUGUUUUACGCA | 165-185 | A-1100537.1 | 1880 | UGCGUAAAACAAUACAGUUUAAG | 163-185 |
| AD-579977.1 | A-1110834.1 | 1794 | UCACCGGAAAGACCGAUUAAA | 1637-1657 | A-1102124.1 | 1881 | UUUAAUCGGUCUUUCCGGUGAGA | 1635-1657 |
| AD-579978.1 | A-1110835.1 | 1795 | CACCGGAAAGACCGAUUAACA | 1638-1658 | A-1102126.1 | 1882 | UGUUAAUCGGUCUUUCCGGUGAG | 1636-1658 |
| AD-579979.1 | A-1110836.1 | 1796 | CCGGAAAGACCGAUUAACCAA | 1640-1660 | A-1102130.1 | 1883 | UUGGUUAAUCGGUCUUUCCGGUG | 1638-1660 |
| AD-579980.1 | A-1110837.1 | 1797 | GAACUGGAUUCGCCAUUUUCA | 1824-1844 | A-1102456.1 | 1884 | UGAAAAUGGCGAAUCCAGUUCCA | 1822-1844 |
| AD-579981.1 | A-1110838.1 | 1798 | CACUGGAUAUGUUUGACUGCA | 2042-2062 | A-1102662.1 | 1885 | UGCAGUCAAACAUAUCCAGUGAA | 2040-2062 |
| AD-579982.1 | A-1110839.1 | 1799 | GGACCUUGUGUGAUCAGACCA | 2591-2611 | A-1103464.1 | 1886 | UGGUCUGAUCACACAAGGUCCUC | 2589-2611 |
| AD-579983.1 | A-1110840.1 | 1800 | UCAGACCAUUGAAACCACUAA | 2604-2624 | A-1103490.1 | 1887 | UUAGUGGUUUCAAUGGUCUGAUC | 2602-2624 |
| AD-579984.1 | A-1110841.1 | 1801 | CAUUGAAACCACUAAUUCUGA | 2610-2630 | A-1103502.1 | 1888 | UCAGAAUUAGUGGUUUCAAUGGU | 2608-2630 |
| AD-579985.1 | A-1110842.1 | 1802 | CUAGAGCAGUUUUCCGAGAUA | 3352-3372 | A-1103920.1 | 1889 | UAUCUCGGAAAACUGCUCUAGAG | 3350-3372 |

TABLE 5B-continued

Exemplary Rat VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
|---|---|---|---|---|---|---|---|---|
| AD-579986.1 | A-1110843.1 | 1803 | UAGAGCAGUUUUCCGAGAUAA | 3353-3373 | A-1103922.1 | 1890 | UUAUCUCGGAAAACUGCUCUAGA | 3351-3373 |
| AD-579987.1 | A-1110844.1 | 1804 | AGUUUUCCGAGAUAUUCCGUA | 3359-3379 | A-1103934.1 | 1891 | UACGGAAUAUCUCGGAAAACUGC | 3357-3379 |
| AD-579988.1 | A-1110845.1 | 1805 | GCGGAUCAAACCUCACCAAAA | 1332-1352 | A-1101748.1 | 1892 | UUUUGGUGAGGUUUGAUCCGCAU | 1330-1352 |
| AD-579989.1 | A-1110846.1 | 1806 | AGCAUUUGUUUGUCCAAGAUA | 1463-1483 | A-1101962.1 | 1893 | UAUCUUGGACAAACAAAUGCUUU | 1461-1483 |
| AD-579990.1 | A-1110847.1 | 1807 | UCUCACCGGAAAGACCGAUUA | 1635-1655 | A-1102120.1 | 1894 | UAAUCGGUCUUUCCGGUGAGAGG | 1633-1655 |
| AD-579992.1 | A-1110849.1 | 1808 | UCUAGAGCAGUUUUCCGAGAA | 3351-3371 | A-1103918.1 | 1895 | UUCUCGGAAAACUGCUCUAGAGA | 3349-3371 |
| AD-579993.1 | A-1110850.1 | 1809 | AUUGCACGGAAACUUUUCGUA | 625-645 | A-1100955.1 | 1896 | UACGAAAAGUUUCCGUGCAAUCC | 623-645 |
| AD-579995.1 | A-1110852.1 | 1810 | GCUCUGGGAUUUGAUAUUCAA | 127-147 | A-1100507.1 | 1897 | UUGAAUAUCAAAUCCCAGAGCAC | 125-147 |
| AD-579996.1 | A-1110853.1 | 1811 | UGAGCCUUGUUCAGAGCGGAA | 1440-1460 | A-1101930.1 | 1898 | UUCCGCUCUGAACAAGGCUCACA | 1438-1460 |
| AD-579997.1 | A-1110854.1 | 1812 | AGCCUUGUUCAGAGCGGAGAA | 1442-1462 | A-1101934.1 | 1899 | UUCUCCGCUCUGAACAAGGCUCA | 1440-1462 |
| AD-579998.1 | A-1110855.1 | 1813 | CAUUUGUUUGUCCAAGAUCCA | 1465-1485 | A-1101966.1 | 1900 | UGGAUCUUGGACAAACAAAUGCU | 1463-1485 |
| AD-579999.1 | A-1110856.1 | 1814 | GGAAAGACCGAUUAACCAUGA | 1642-1662 | A-1102134.1 | 1901 | UCAUGGUUAAUCGGUCUUUCCGG | 1640-1662 |
| AD-580000.1 | A-1110857.1 | 1815 | GAAAGACCGAUUAACCAUGUA | 1643-1663 | A-1102136.1 | 1902 | UACAUGGUUAAUCGGUCUUUCCG | 1641-1663 |
| AD-580001.1 | A-1110858.1 | 1816 | AAGACCGAUUAACCAUGUCAA | 1645-1665 | A-1102140.1 | 1903 | UUGACAUGGUUAAUCGGUCUUUC | 1643-1665 |
| AD-580002.1 | A-1110859.1 | 1817 | GACCGAUUAACCAUGUCACCA | 1647-1667 | A-1102144.1 | 1904 | UGGUGACAUGGUUAAUCGGUCUU | 1645-1667 |

TABLE 8A

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1222866.1 | A-2282111.1 | 2000 | csgsgugcUfgGfAfAfuuugauauuaL96 | A-2282112.1 | 2449 | VPusAfsauaUfcaaauucCfaGfcaccgsasg | CUCGGUGCUGGAAUUUGAUAUUC | 4700 |
| AD-1222867.1 | A-2282113.1 | 2001 | gsgsugcuGfgAfAfUfuugauauucaL96 | A-2282114.1 | 2450 | VPusGfsaauAfucaaauuCfcAfgcaccgsgsa | UCGGUGCUGGAAUUUGAUAUUCA | 4701 |
| AD-1222868.1 | A-2282115.1 | 2002 | usgscuggAfaUfUfUfgauauucauaL96 | A-2282116.1 | 2451 | VPusAfsugaAfuaucaaaUfuCfcagcascsc | GGUGCUGGAAUUUGAUAUUCAUU | 4702 |
| AD-1222869.1 | A-2282117.1 | 2003 | gscsuggaAfuUfUfGfauauucauuaL96 | A-2282118.1 | 2452 | VPusAfsaugAfauaucaaAfuUfccagcsasc | GUGCUGGAAUUUGAUAUUCAUUG | 4703 |
| AD-1222870.1 | A-2282119.1 | 2004 | usgsgaauUfuGfAfUfauucauugaaL96 | A-2282120.1 | 2453 | VPusUfscaaUfgaauaucAfaAfuuccasgsc | GCUGGAAUUUGAUAUUCAUUGAU | 4704 |
| AD-1222871.1 | A-2282121.1 | 2005 | gsgsaauuUfgAfUfAfuucauugauaL96 | A-2282122.1 | 2454 | VPusAfsucaAfugaauauCfaAfauuccsasg | CUGGAAUUUGAUAUUCAUUGAUC | 4705 |
| AD-1222872.1 | A-2282123.1 | 2006 | gsasauuuGfaUfAfUfucauugaucaL96 | A-2282124.1 | 2455 | VPusGfsaucAfaugaauaUfcAfaauucscsa | UGGAAUUUGAUAUUCAUUGAUCC | 4706 |
| AD-1222873.1 | A-2282125.1 | 2007 | asasuuugAfuAfUfUfcauugauccaL96 | A-2282126.1 | 2456 | VPusGfsgauCfaaugaauAfuCfaaauuscsc | GGAAUUUGAUAUUCAUUGAUCCG | 4707 |
| AD-1222874.1 | A-2282127.1 | 2008 | asusuugaUfaUfUfCfauugauccgaL96 | A-2282128.1 | 2457 | VPusCfsggaUfcaaugaaUfaUfcaaausuc | GAAUUUGAUAUUCAUUGAUCCGG | 4708 |
| AD-1222875.1 | A-2282129.1 | 2009 | ususugauAfuUfCfAfuugauccggaL96 | A-2282130.1 | 2458 | VPusCfscggAfucaaugaAfuAfucaaasusu | AAUUUGAUAUUCAUUGAUCCGGG | 4709 |
| AD-1222876.1 | A-2282131.1 | 2010 | ususuauuUfuUfGfCfuugccauucaL96 | A-2282132.1 | 2459 | VPusGfsaauGfgcaagcaAfaAfauaaasusu | AAUUUAUUUUUGCUUGCCAUUCC | 4710 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1222877.1 | A-2282133.1 | 2011 | ususauuuUfuGfCfUfugccauuccaL96 | A-2282134.1 | 2460 | VPusGfsgaaUfggcaagcAfaAfaauaaasasu | AUUUAUUUUUGCUUGCCAUUCCC | 4711 |
| AD-1222878.1 | A-2282135.1 | 2012 | csasaaucAfcUfGfUfggauuuuggaL96 | A-2282136.1 | 2461 | VPusCfscaaAfauccacaGfuGfauuugsgsg | CCCAAAUCACUGUGGAUUUUGGA | 4712 |
| AD-1222879.1 | A-2282137.1 | 2013 | asasaucaCfuGfUfGfgauuuuggaaL96 | A-2282138.1 | 2462 | VPusUfsccaAfaauccacAfgUfgauuusgsg | CCAAAUCACUGUGGAUUUUGGAA | 4713 |
| AD-1222880.1 | A-2282139.1 | 2014 | asasucacUfgUfGfGfauuuuggaaaL96 | A-2282140.1 | 2463 | VPusUfsuccAfaaauccaCfaGfugauusUsg | CAAAUCACUGUGGAUUUUGGAAA | 4714 |
| AD-1222881.1 | A-2282141.1 | 2015 | asuscacuGfuGfGfAfuuuuggaaaaL96 | A-2282142.1 | 2464 | VPusUfsuucCfaaaauccAfcAfgugausUsu | AAAUCACUGUGGAUUUUGGAAAC | 4715 |
| AD-1222882.1 | A-2282143.1 | 2016 | uscsacugUfgGfAfUfuuuggaaacaL96 | A-2282144.1 | 2465 | VPusGfsuuuCfcaaaaucCfaCfagugasusu | AAUCACUGUGGAUUUUGGAAACC | 4716 |
| AD-1222883.1 | A-2282145.1 | 2017 | csascuguGfgAfUfUfuuggaaaccaL96 | A-2282146.1 | 2466 | VPusGfsguuUfccaaaauCfcAfcagugsasu | AUCACUGUGGAUUUUGGAAACCA | 4717 |
| AD-1222884.1 | A-2282147.1 | 2018 | ascsugugGfaUfUfUfuggaaaccaaL96 | A-2282148.1 | 2467 | VPusUfsgguUfuccaaaaUfcCfacagusgsa | UCACUGUGGAUUUUGGAAACCAG | 4718 |
| AD-1222885.1 | A-2282149.1 | 2019 | csusguggAfuUfUfUfggaaaccagaL96 | A-2282150.1 | 2468 | VPusCfsuggUfuuccaaaAfuCfcacagsusg | CACUGUGGAUUUUGGAAACCAGC | 4719 |
| AD-1222886.1 | A-2282151.1 | 2020 | usgsuggaUfuUfUfGfgaaaccagcaL96 | A-2282152.1 | 2469 | VPusGfscugGfuuuccaaAfaUfccacasgsu | ACUGUGGAUUUUGGAAACCAGCA | 4720 |
| AD-1222887.1 | A-2282153.1 | 2021 | gsusggauUfuUfGfGfaaaccagcaaL96 | A-2282154.1 | 2470 | VPusUfsgcuGfguuuccaAfaAfuccacsasg | CUGUGGAUUUUGGAAACCAGCAG | 4721 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1222888.1 | A-2282155.1 | 2022 | gsasuuuuGfgAfAfAfccagcagaaaL96 | A-2282156.1 | 2471 | VPusUfsucuGfcugguuuCfcAfaaaucscsa | UGGAUUUUGGAAACCAGCAGAAA | 4722 |
| AD-1222889.1 | A-2282157.1 | 2023 | asusuuugGfaAfAfCfcagcagaaaaL96 | A-2282158.1 | 2472 | VPusUfsuucUfgcugguuUfcCfaaaauscsc | GGAUUUUGGAAACCAGCAGAAAG | 4723 |
| AD-1222890.1 | A-2282159.1 | 2024 | ususuuggAfaAfCfCfagcagaaagaL96 | A-2282160.1 | 2473 | VPusCfsuuuCfugcugguUfuCfcaaaasusc | GAUUUUGGAAACCAGCAGAAAGA | 4724 |
| AD-1222891.1 | A-2282161.1 | 2025 | ususuggaAfaCfCfAfgcagaaagaaL96 | A-2282162.1 | 2474 | VPusUfscuuUfcugcuggUfuUfccaaasasu | AUUUUGGAAACCAGCAGAAAGAG | 4725 |
| AD-1222892.1 | A-2282163.1 | 2026 | gsgsaaacCfaGfCfAfgaaagaggaaL96 | A-2282164.1 | 2475 | VPusUfsccuCfuuucugcUfgGfuuuccsasa | UUGGAAACCAGCAGAAAGAGGAA | 4726 |
| AD-1222893.1 | A-2282165.1 | 2027 | asasaccaGfcAfGfAfaagaggaaaaL96 | A-2282166.1 | 2476 | VPusUfsuucCfucuuucuGfcUfgguuuscsc | GGAAACCAGCAGAAAGAGGAAAG | 4727 |
| AD-1222894.1 | A-2282167.1 | 2028 | asasccagCfaGfAfAfagaggaaagaL96 | A-2282168.1 | 2477 | VPusCfsuuuCfcucuuucUfgCfugguususc | GAAACCAGCAGAAAGAGGAAAGA | 4728 |
| AD-1222895.1 | A-2282169.1 | 2029 | ascscagcAfgAfAfAfgaggaaagaaL96 | A-2282170.1 | 2478 | VPusUfscuuUfccucuuuCfuGfcuggususu | AAACCAGCAGAAAGAGGAAAGAG | 4729 |
| AD-1222896.1 | A-2282171.1 | 2030 | cscsagcaGfaAfAfGfaggaaagagaL96 | A-2282172.1 | 2479 | VPusCfsucuUfuccucuuUfcUfgcuggsusu | AACCAGCAGAAAGAGGAAAGAGG | 4730 |
| AD-1222897.1 | A-2282173.1 | 2031 | csasgcagAfaAfGfAfggaaagaggaL96 | A-2282174.1 | 2480 | VPusCfscucUfuuccucuUfuCfugcugsgsu | ACCAGCAGAAAGAGGAAAGAGGU | 4731 |
| AD-1222898.1 | A-2282175.1 | 2032 | asgscagaAfaGfAfGfgaaagagguaL96 | A-2282176.1 | 2481 | VPusAfsccuCfuuuccucUfuUfcugcusgsg | CCAGCAGAAAGAGGAAAGAGGUA | 4732 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1222899.1 | A-2282177.1 | 2033 | gscsagaaAfgAfGfGfaaagagguaaL96 | A-2282178.1 | 2482 | VPusUfsaccUfcuuuccuCfuUfucugcsusg | CAGCAGAAAGAGGAAAGAGGUAG | 4733 |
| AD-1222900.1 | A-2282179.1 | 2034 | csasgaaaGfaGfGfAfaagagguagaL96 | A-2282180.1 | 2483 | VPusCfsuacCfucuuuccUfcUfuucugscsu | AGCAGAAAGAGGAAAGAGGUAGC | 4734 |
| AD-1222901.1 | A-2282181.1 | 2035 | asasagagGfaAfAfGfagguagcaaaL96 | A-2282182.1 | 2484 | VPusUfsugcUfaccucuuUfcCfucuuuscsu | AGAAAGAGGAAAGAGGUAGCAAG | 4735 |
| AD-1222902.1 | A-2282183.1 | 2036 | asasgaggAfaAfGfAfgguagcaagaL96 | A-2282184.1 | 2485 | VPusCfsuugCfuaccucuUfuCfcucuuusuc | GAAAGAGGAAAGAGGUAGCAAGA | 4736 |
| AD-1222903.1 | A-2282185.1 | 2037 | asgsaggaAfaGfAfGfguagcaagaL96 | A-2282186.1 | 2486 | VPusUfscuuGfcuaccucUfuUfccucususu | AAAGAGGAAAGAGGUAGCAAGAG | 4737 |
| AD-1222904.1 | A-2282187.1 | 2038 | gsasggaaAfgAfGfGfuagcaagagaL96 | A-2282188.1 | 2487 | VPusCfsucuUfgcuaccuCfuUfucccucsusu | AAGAGGAAAGAGGUAGCAAGAGC | 4738 |
| AD-1222905.1 | A-2282189.1 | 2039 | gsgsaaagAfgGfUfAfgcaagagcuaL96 | A-2282190.1 | 2488 | VPusAfsgcuCfuugcuacCfuCfuuuccsusc | GAGGAAAGAGGUAGCAAGAGCUC | 4739 |
| AD-1222906.1 | A-2282191.1 | 2040 | asgsguagCfaAfGfAfgcuccagagaL96 | A-2282192.1 | 2489 | VPusCfsucuGfgagcucuUfgCfuaccuscsu | AGAGGUAGCAAGAGCUCCAGAGA | 4740 |
| AD-1222907.1 | A-2282193.1 | 2041 | uscscagaGfaGfAfAfgucgaggaaaL96 | A-2282194.1 | 2490 | VPusUfsuccUfcgacuucUfcUfcuggasgsc | GCUCCAGAGAGAAGUCGAGGAAG | 4741 |
| AD-1222908.1 | A-2282195.1 | 2042 | cscsagagAfgAfAfGfucgaggaagaL96 | A-2282196.1 | 2491 | VPusCfsuucCfucgacuuCfuCfucuggsasg | CUCCAGAGAGAAGUCGAGGAAGA | 4742 |
| AD-1222909.1 | A-2282197.1 | 2043 | csasgagaGfaAfGfUfcgaggaagaL96 | A-2282198.1 | 2492 | VPusUfscuuCfcucgacuUfcUfcucugsgsa | UCCAGAGAGAAGUCGAGGAAGAG | 4743 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1222910.1 | A-2282199.1 | 2044 | asgsagaaGfuCfGfAfggaagagagaL96 | A-2282200.1 | 2493 | VPusCfsucuCfuuccucgAfcUfucucuscsu | AGAGAGAAGUCGAGGAAGAGAGA | 4744 |
| AD-1222911.1 | A-2282201.1 | 2045 | gsasgaagUfcGfAfGfgaagagagaaL96 | A-2282202.1 | 2494 | VPusUfscucUfcuuccucGfaCfuucucsusc | GAGAGAAGUCGAGGAAGAGAGAG | 4745 |
| AD-1222912.1 | A-2282203.1 | 2046 | gsasagucGfaGfGfAfagagagagaaL96 | A-2282204.1 | 2495 | VPusUfscucUfcucuuccUfcGfacuucsusc | GAGAAGUCGAGGAAGAGAGAC | 4746 |
| AD-1222913.1 | A-2282205.1 | 2047 | asgsugagUfgAfCfCfugcuuuuggaL96 | A-2282206.1 | 2496 | VPusCfscaaAfagcagguCfaCfucacususu | AAAGUGAGUGACCUGCUUUUGGG | 4747 |
| AD-1222914.1 | A-2282207.1 | 2048 | gsgscgucGfcAfCfUfgaaacuuuuaL96 | A-2282208.1 | 2497 | VPusAfsaaaGfuuucaguGfcGfacgccsgsc | GCGGCGUCGCACUGAAACUUUUC | 4748 |
| AD-1222915.1 | A-2282209.1 | 2049 | gsuscgcaCfuGfAfAfacuuuucguaL96 | A-2282210.1 | 2498 | VPusAfscgaAfaaguuucAfgUfgcgacsgsc | GCGUCGCACUGAAACUUUUCGUC | 4749 |
| AD-1222916.1 | A-2282211.1 | 2050 | uscsgcacUfgAfAfAfcuuuucgucaL96 | A-2282212.1 | 2499 | VPusGfsacgAfaaaguuuCfaGfugcgascsg | CGUCGCACUGAAACUUUUCGUCC | 4750 |
| AD-1222917.1 | A-2282213.1 | 2051 | csascugaAfaCfUfUfuucguccaaaL96 | A-2282214.1 | 2500 | VPusUfsuggAfcgaaaagUfuUfcagugscsg | CGCACUGAAACUUUUCGUCCAAC | 4751 |
| AD-1222918.1 | A-2282215.1 | 2052 | ascsugaaAfcUfUfUfucguccaacaL96 | A-2282216.1 | 2501 | VPusGfsuugGfacgaaaaGfuUfucagusgsc | GCACUGAAACUUUUCGUCCAACU | 4752 |
| AD-1222920.1 | A-2282219.1 | 2053 | usgsaaacUfuUfUfCfguccaacuuaL96 | A-2282220.1 | 2502 | VPusAfsaguUfggacgaaAfaGfuuucasgsu | ACUGAAACUUUUCGUCCAACUUC | 4753 |
| AD-1222921.1 | A-2282221.1 | 2054 | asascuuuUfcGfUfCfcaacuucugaL96 | A-2282222.1 | 2503 | VPusCfsagaAfguuggacGfaAfaaguusus c | GAAACUUUUCGUCCAACUUCUGG | 4754 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-12229 22.1 | A-22822 23.1 | 2055 | csusgggcUfgUfUfCfucgcuu cggaL96 | A-228222 4.1 | 2504 | VPusCfscgaAfgcgagaaC faGfcccagsasa | UUCUGGGCUGUUCU CGCUUCGGA | 4755 |
| AD-12229 23.1 | A-22822 25.1 | 2056 | usgsggcuGfuUfCfUfcgcuuc ggaaL96 | A-228222 6.1 | 2505 | VPusUfsccgAfagcgagaA fcAfgcccasgsa | UCUGGGCUGUUCUC GCUUCGGAG | 4756 |
| AD-12229 24.1 | A-22822 27.1 | 2057 | gsgsgcugUfuCfUfCfgcuucg gagaL96 | A-228222 8.1 | 2506 | VPusCfsuccGfaagcgagA faCfagcccsasg | CUGGGCUGUUCUCG CUUCGGAGG | 4757 |
| AD-12229 25.1 | A-22822 29.1 | 2058 | gscsuguuCfuCfGfCfuucgga ggaaL96 | A-228223 0.1 | 2507 | VPusUfsccuCfcgaagcgA fgAfacagcscsc | GGGCUGUUCUCGCU UCGGAGGAG | 4758 |
| AD-12229 26.1 | A-22822 31.1 | 2059 | gscscgcgAfgAfAfGfugcuag cucaL96 | A-228223 2.1 | 2508 | VPusGfsagcUfagcacuuC fuCfgcggcsusc | GAGCCGCGAGAAGU GCUAGCUCG | 4759 |
| AD-12229 27.1 | A-22822 33.1 | 2060 | cscsgcgaGfaAfGfUfgcuagc ucgaL96 | A-228223 4.1 | 2509 | VPusCfsgagCfuagcacuU fcUfcgcggscsu | AGCCGCGAGAAGUG CUAGCUCGG | 4760 |
| AD-12229 28.1 | A-22822 35.1 | 2061 | gscscuccGfaAfAfCfcaugaa cuuaL96 | A-228223 6.1 | 2510 | VPusAfsaguUfcaugguu UfcGfgaggcscsc | GGGCCUCCGAAACC AUGAACUUU | 4761 |
| AD-12229 29.1 | A-22822 37.1 | 2062 | asasggagGfaGfGfGfcagaau cauaL96 | A-228223 8.1 | 2511 | VPusAfsugaUfucugccc UfcCfuccuuscsu | AGAAGGAGGAGGGC AGAAUCAUC | 4762 |
| AD-12229 30.1 | A-22822 39.1 | 2063 | gsgscagaAfuCfAfUfcacgaa gugaL96 | A-228224 0.1 | 2512 | VPusCfsacuUfcgugaug AfuUfcugccscsu | AGGGCAGAAUCAUC ACGAAGUGG | 4763 |
| AD-12229 31.1 | A-22822 41.1 | 2064 | asasucauCfaCfGfAfaguggu gaaaL96 | A-228224 2.1 | 2513 | VPusUfsucaCfcacuucgU fgAfugauuscsu | AGAAUCAUCACGAA GUGGUGAAG | 4764 |
| AD-12229 32.1 | A-22822 43.1 | 2065 | asuscaucAfcGfAfAfguggug aagaL96 | A-228224 4.1 | 2514 | VPusCfsuucAfccacuucG fuGfaugausus c | GAAUCAUCACGAAG UGGUGAAGU | 4765 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1222933.1 | A-2282245.1 | 2066 | uscsaucaCfgAfAfGfugguga aguaL96 | A-2282246.1 | 2515 | VPusAfscuuCfaccacuuC fgUfgaugasusu | AAUCAUCACGAAGU GGUGAAGUU | 4766 |
| AD-1222934.1 | A-2282247.1 | 2067 | csasucacGfaAfGfUfggugaa guuaL96 | A-2282248.1 | 2516 | VPusAfsacuUfcaccacuU fcGfugaugsasu | AUCAUCACGAAGUG GUGAAGUUC | 4767 |
| AD-1222935.1 | A-2282249.1 | 2068 | uscsacgaAfgUfGfGfugaagu ucaaL96 | A-2282250.1 | 2517 | VPusUfsgaaCfuucaccaC fuUfcgugasusg | CAUCACGAAGUGGU GAAGUUCAU | 4768 |
| AD-1222936.1 | A-2282251.1 | 2069 | asasguggUfgAfAfGfuucaug gauaL96 | A-2282252.1 | 2518 | VPusAfsuccAfugaacuuC faCfcacuuscsg | CGAAGUGGUGAAGU UCAUGGAUG | 4769 |
| AD-1222937.1 | A-2282253.1 | 2070 | asgsugguGfaAfGfUfucaugg augaL96 | A-2282254.1 | 2519 | VPusCfsaucCfaugaacuU fcAfccacusuc | GAAGUGGUGAAGU UCAUGGAUGU | 4770 |
| AD-1222938.1 | A-2282255.1 | 2071 | gsusggugAfaGfUfUfcaugga uguaL96 | A-2282256.1 | 2520 | VPusAfscauCfcaugaacU fuCfaccacsusu | AAGUGGUGAAGUUC AUGGAUGUC | 4771 |
| AD-1222939.1 | A-2282257.1 | 2072 | gsgsugaaGfuUfCfAfuggaug ucuaL96 | A-2282258.1 | 2521 | VPusAfsgacAfuccaugaA fcUfucaccsasc | GUGGUGAAGUUCAU GGAUGUCUA | 4772 |
| AD-1222940.1 | A-2282259.1 | 2073 | gsusgaagUfuCfAfUfggaugu cuaaL96 | A-2282260.1 | 2522 | VPusUfsagaCfauccaugA faCfuucacscsa | UGGUGAAGUUCAUG GAUGUCUAU | 4773 |
| AD-1222941.1 | A-2282261.1 | 2074 | usgsaaguUfcAfUfGfgauguc uauaL96 | A-2282262.1 | 2523 | VPusAfsuagAfcauccauG faAfcuucascsc | GGUGAAGUUCAUGG AUGUCUAUC | 4774 |
| AD-1222942.1 | A-2282263.1 | 2075 | asasguucAfuGfGfAfugucua ucaaL96 | A-2282264.1 | 2524 | VPusUfsgauAfgacauccA fuGfaacuuscsa | UGAAGUUCAUGGAU GUCUAUCAG | 4775 |
| AD-1222943.1 | A-2282265.1 | 2076 | asgsuucaUfgGfAfUfgucuau cagaL96 | A-2282266.1 | 2525 | VPusCfsugaUfagacaucC faUfgaacusuc | GAAGUUCAUGGAUG UCUAUCAGC | 4776 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1222944.1 | A-2282267.1 | 2077 | ususcaugGfaUfGfUfcuaucagcgaL96 | A-2282268.1 | 2526 | VPusCfsgcuGfauagacaUfcCfaugaascsu | AGUUCAUGGAUGUCUAUCAGCGC | 4777 |
| AD-1222945.1 | A-2282269.1 | 2078 | gsusggacAfuCfUfUfccaggaguaaL96 | A-2282270.1 | 2527 | VPusUfsacuCfcuggaagAfuGfuccacscsa | UGGUGGACAUCUUCCAGGAGUAC | 4778 |
| AD-1222946.1 | A-2282271.1 | 2079 | uscsgaguAfcAfUfCfuucaagccaaL96 | A-2282272.1 | 2528 | VPusUfsggcUfugaagauGfuAfcucgasusc | GAUCGAGUACAUCUUCAAGCCAU | 4779 |
| AD-1222947.1 | A-2282273.1 | 2080 | csgsaguaCfaUfCfUfucaagccauaL96 | A-2282274.1 | 2529 | VPusAfsuggCfuugaagaUfgUfacucgsasu | AUCGAGUACAUCUUCAAGCCAUC | 4780 |
| AD-1222948.1 | A-2282275.1 | 2081 | gsasguacAfuCfUfUfcaagccaucaL96 | A-2282276.1 | 2530 | VPusGfsaugGfcuugaagAfuGfuacucsgsa | UCGAGUACAUCUUCAAGCCAUCC | 4781 |
| AD-1222949.1 | A-2282277.1 | 2082 | gsusacauCfuUfCfAfagccauccuaL96 | A-2282278.1 | 2531 | VPusAfsggaUfggcuugaAfgAfuguacsusc | GAGUACAUCUUCAAGCCAUCCUG | 4782 |
| AD-1222950.1 | A-2282279.1 | 2083 | cscsaacaUfcAfCfCfaugcagauuaL96 | A-2282280.1 | 2532 | VPusAfsaucUfgcaugguGfaUfguuggsasc | GUCCAACAUCACCAUGCAGAUUA | 4783 |
| AD-1222951.1 | A-2282281.1 | 2084 | csasacauCfaCfCfAfugcagauuaaL96 | A-2282282.1 | 2533 | VPusUfsaauCfugcauggUfgAfuguugsgsa | UCCAACAUCACCAUGCAGAUUAU | 4784 |
| AD-1222952.1 | A-2282283.1 | 2085 | ascsaucaCfAfUfGfcagauuaugaL96 | A-2282284.1 | 2534 | VPusCfsauaAfucugcauGfgUfgaugusgsg | CAACAUCACCAUGCAGAUUAUGC | 4785 |
| AD-1222953.1 | A-2282285.1 | 2086 | csasucacCfaUfGfCfagauuaugcaL96 | A-2282286.1 | 2535 | VPusGfscauAfaucugcaUfgGfugaugsusu | AACAUCACCAUGCAGAUUAUGCG | 4786 |
| AD-1222954.1 | A-2282287.1 | 2087 | ascscaugCfaGfAfUfuaugcggauaL96 | A-2282288.1 | 2536 | VPusAfsuccGfcauaaucUfgCfauggusgsa | UCACCAUGCAGAUUAUGCGGAUC | 4787 |

TABLE 8A-continued

| Exemplary Human VEGF-A siRNA Modified Single Strands and Duplex Sequences | | | | | | | | |
|---|---|---|---|---|---|---|---|---|
| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
| AD-122955.1 | A-2282289.1 | 2088 | asusgcagAfuUfAfUfgcggaucaaaL96 | A-2282290.1 | 2537 | VPusUfsugaUfccgcauaAfuCfugcausgsg | CCAUGCAGAUUAUGCGGAUCAAA | 4788 |
| AD-122956.1 | A-2282291.1 | 2089 | usgscagaUfuAfUfGfcggaucaaaL96 | A-2282292.1 | 2538 | VPusUfsuugAfuccgcauAfaUfcugcasusg | CAUGCAGAUUAUGCGGAUCAAAC | 4789 |
| AD-122957.1 | A-2282293.1 | 2090 | gscsagauUfaUfGfCfggaucaaacaL96 | A-2282294.1 | 2539 | VPusGfsuuuGfauccgcaUfaAfucugcsasu | AUGCAGAUUAUGCGGAUCAAACC | 4790 |
| AD-122958.1 | A-2282295.1 | 2091 | gsasuuauGfcGfGfAfucaaaccucaL96 | A-2282296.1 | 2540 | VPusGfsaggUfuugauccGfcAfuaaucsusg | CAGAUUAUGCGGAUCAAACCUCA | 4791 |
| AD-122959.1 | A-2282297.1 | 2092 | asusuaugCfgGfAfUfcaaaccucaaL96 | A-2282298.1 | 2541 | VPusUfsgagGfuuugaucCfgCfauaauscsu | AGAUUAUGCGGAUCAAACCUCAC | 4792 |
| AD-122960.1 | A-2282299.1 | 2093 | csgsgaucAfaAfCfCfucaccaaggaL96 | A-2282300.1 | 2542 | VPusCfscuuGfgugagguUfuGfauccgscsa | UGCGGAUCAAACCUCACCAAGGC | 4793 |
| AD-122961.1 | A-2282301.1 | 2094 | gsgsagagAfuGfAfGfcuuccuacaaL96 | A-2282302.1 | 2543 | VPusUfsguaGfgaagcucAfuCfucuccsusa | UAGGAGAGAUGAGCUUCCUACAG | 4794 |
| AD-122962.1 | A-2282303.1 | 2095 | gsasgaugAfgCfUfUfccuacagcaaL96 | A-2282304.1 | 2544 | VPusUfsgcuGfuaggaagCfuCfaucucsusc | GAGAGAUGAGCUUCCUACAGCAC | 4795 |
| AD-122963.1 | A-2282305.1 | 2096 | gsasugagCfuUfCfCfuacagcacaaL96 | A-2282306.1 | 2545 | VPusUfsgugCfuguaggaAfgCfucaucsusc | GAGAUGAGCUUCCUACAGCACAA | 4796 |
| AD-122964.1 | A-2282307.1 | 2097 | asusgagcUfuCfCfUfacagcacaaaL96 | A-2282308.1 | 2546 | VPusUfsuguGfcuguaggAfaGfcucauscsu | AGAUGAGCUUCCUACAGCACAAC | 4797 |
| AD-122965.1 | A-2282309.1 | 2098 | gsasgcuuCfcUfAfCfagcacaacaaL96 | A-2282310.1 | 2547 | VPusUfsguuGfugcuguaGfgAfagcucsasu | AUGAGCUUCCUACAGCACAACAA | 4798 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1222966.1 | A-2282311.1 | 2099 | asgscuucCfuAfCfAfgcacaacaaaL96 | A-2282312.1 | 2548 | VPusUfsuguUfgugcuguAfgGfaagcuscsa | UGAGCUUCCUACAGCACAACAAA | 4799 |
| AD-1222967.1 | A-2282313.1 | 2100 | gscsuuccUfaCfAfGfcacaacaaaaL96 | A-2282314.1 | 2549 | VPusUfsuugUfugugcugUfaGfgaagcsusc | GAGCUUCCUACAGCACAACAAAU | 4800 |
| AD-1222968.1 | A-2282315.1 | 2101 | csusuccuAfcAfGfCfacaacaaauaL96 | A-2282316.1 | 2550 | VPusAfsuuuGfuugugcuGfuAfggaagscsu | AGCUUCCUACAGCACAACAAAUG | 4801 |
| AD-1222969.1 | A-2282317.1 | 2102 | uscscuacAfgCfAfCfaacaaauguaL96 | A-2282318.1 | 2551 | VPusAfscauUfuguugugCfuGfuaggasasg | CUUCCUACAGCACAACAAAUGUG | 4802 |
| AD-1222970.1 | A-2282319.1 | 2103 | csusacagCfaCfAfAfcaaaugugaaL96 | A-2282320.1 | 2552 | VPusUfscacAfuuuguugUfgCfuguagsgsa | UCCUACAGCACAACAAAUGUGAA | 4803 |
| AD-1222971.1 | A-2282321.1 | 2104 | usascagcAfcAfAfCfaaaugugaaaL96 | A-2282322.1 | 2553 | VPusUfsucaCfauuuguuGfuGfcuguasgsg | CCUACAGCACAACAAAUGUGAAU | 4804 |
| AD-1222972.1 | A-2282323.1 | 2105 | asgscacaAfcAfAfAfugugaaugcaL96 | A-2282324.1 | 2554 | VPusGfscauUfcacauuuGfuUfgugcusgsu | ACAGCACAACAAAUGUGAAUGCA | 4805 |
| AD-1222973.1 | A-2282325.1 | 2106 | gscsacaaCfaAfAfUfgugaaugcaaL96 | A-2282326.1 | 2555 | VPusUfsgcaUfucacauuUfgUfugugcsusg | CAGCACAACAAAUGUGAAUGCAG | 4806 |
| AD-1222974.1 | A-2282327.1 | 2107 | csuscaccAfgGfAfAfagacugauaaL96 | A-2282328.1 | 2556 | VPusUfsaucAfgucuuucCfuGfgugagsasg | CUCUCACCAGGAAAGACUGAUAC | 4807 |
| AD-1222975.1 | A-2282329.1 | 2108 | uscsaccaGfgAfAfAfgacugauacaL96 | A-2282330.1 | 2557 | VPusGfsuauCfagucuuuCfcUfggugasgsa | UCUCACCAGGAAAGACUGAUACA | 4808 |
| AD-1222976.1 | A-2282331.1 | 2109 | csasccagGfaAfAfGfacugauacaaL96 | A-2282332.1 | 2558 | VPusUfsguaUfcagucuuUfcCfuggugsasg | CUCACCAGGAAAGACUGAUACAG | 4809 |

TABLE 8A-continued

| Exemplary Human VEGF-A siRNA Modified Single Strands and Duplex Sequences | | | | | | | | |
|---|---|---|---|---|---|---|---|---|
| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
| AD-1222977.1 | A-2282333.1 | 2110 | ascscaggAfaAfGfAfcugauacagaL96 | A-2282334.1 | 2559 | VPusCfsuguAfucagucuUfuCfcuggusgsa | UCACCAGGAAAGACUGAUACAGA | 4810 |
| AD-1222978.1 | A-2282335.1 | 2111 | cscsaggaAfaGfAfCfugauacagaaL96 | A-2282336.1 | 2560 | VPusUfscugUfaucagucUfuUfccuggsusg | CACCAGGAAAGACUGAUACAGAA | 4811 |
| AD-1222979.1 | A-2282337.1 | 2112 | csasggaaAfgAfCfUfgauacagaaaL96 | A-2282338.1 | 2561 | VPusUfsucuGfuaucaguCfuUfuccugsgsu | ACCAGGAAAGACUGAUACAGAAC | 4812 |
| AD-1222980.1 | A-2282339.1 | 2113 | asgsgaaaGfaCfUfGfauacagaacaL96 | A-2282340.1 | 2562 | VPusGfsuucUfguaucagUfcUfuuccusgsg | CCAGGAAAGACUGAUACAGAACG | 4813 |
| AD-1222981.1 | A-2282341.1 | 2114 | gsgsaaagAfcUfGfAfuacagaacgaL96 | A-2282342.1 | 2563 | VPusCfsguuCfuguaucaGfuCfuuuccsusg | CAGGAAAGACUGAUACAGAACGA | 4814 |
| AD-1222982.1 | A-2282343.1 | 2115 | gsasaagaCfuGfAfUfacagaacgaaL96 | A-2282344.1 | 2564 | VPusUfscguUfcuguaucAfgUfcuuucscsu | AGGAAAGACUGAUACAGAACGAU | 4815 |
| AD-1222983.1 | A-2282345.1 | 2116 | asasagacUfgAfUfAfcagaacgauaL96 | A-2282346.1 | 2565 | VPusAfsucgUfucuguauCfaGfucuuuscsc | GGAAAGACUGAUACAGAACGAUC | 4816 |
| AD-1222984.1 | A-2282347.1 | 2117 | asasgacuGfaUfAfCfagaacgaucaL96 | A-2282348.1 | 2566 | VPusGfsaucGfuucuguaUfcAfgucuususc | GAAAGACUGAUACAGAACGAUCG | 4817 |
| AD-1222985.1 | A-2282349.1 | 2118 | asgsacugAfuAfCfAfgaacgaucgaL96 | A-2282350.1 | 2567 | VPusCfsgauCfguucuguAfuCfagucususu | AAAGACUGAUACAGAACGAUCGA | 4818 |
| AD-1222986.1 | A-2282351.1 | 2119 | gsascugaUfaCfAfGfaacgaucgaaL96 | A-2282352.1 | 2568 | VPusUfscgaUfcguucugUfaUfcagucsusu | AAGACUGAUACAGAACGAUCGAU | 4819 |
| AD-1222987.1 | A-2282353.1 | 2120 | ascsugauAfcAfGfAfacgaucgauaL96 | A-2282354.1 | 2569 | VPusAfsucgAfucguucuGfuAfucaguscsu | AGACUGAUACAGAACGAUCGAUA | 4820 |

TABLE 8A-continued

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| Exemplary Human VEGF-A siRNA Modified Single Strands and Duplex Sequences | | | | | | | | |
| AD-1222988.1 | A-2282355.1 | 2121 | csusgauaCfaGfAfAfcgaucgauaaL96 | A-2282356.1 | 2570 | VPusUfsaucGfaucguucUfgUfaucagsusc | GACUGAUACAGAACGAUCGAUAC | 4821 |
| AD-1222989.1 | A-2282357.1 | 2122 | usgsauacAfgAfAfCfgaucgauacaL96 | A-2282358.1 | 2571 | VPusGfsuauCfgaucguuCfuGfuaucasgsu | ACUGAUACAGAACGAUCGAUACA | 4822 |
| AD-1222990.1 | A-2282359.1 | 2123 | gsasuacaGfaAfCfGfaucgauacaaL96 | A-2282360.1 | 2572 | VPusUfsguaUfcgaucguUfcUfguaucsasg | CUGAUACAGAACGAUCGAUACAG | 4823 |
| AD-1222991.1 | A-2282361.1 | 2124 | asusacagAfaCfGfAfucgauacagaL96 | A-2282362.1 | 2573 | VPusCfsuguAfucgaucgUfuCfuguauscsa | UGAUACAGAACGAUCGAUACAGA | 4824 |
| AD-1222992.1 | A-2282363.1 | 2125 | usascagaAfcGfAfUfcgauacagaaL96 | A-2282364.1 | 2574 | VPusUfscugUfaucgaucGfuUfcuguasusc | GAUACAGAACGAUCGAUACAGAA | 4825 |
| AD-1222993.1 | A-2282365.1 | 2126 | ascsagaaCfgAfUfCfgauacagaaaL96 | A-2282366.1 | 2575 | VPusUfsucuGfuaucgauCfgUfucugusasu | AUACAGAACGAUCGAUACAGAAA | 4826 |
| AD-1222994.1 | A-2282367.1 | 2127 | csasgaacGfaUfCfGfauacagaaaaL96 | A-2282368.1 | 2576 | VPusUfsuucUfguaucgaUfcGfuucugsusa | UACAGAACGAUCGAUACAGAAAC | 4827 |
| AD-1222995.1 | A-2282369.1 | 2128 | asgsaacgAfuCfGfAfuacagaaacaL96 | A-2282370.1 | 2577 | VPusGfsuuuCfuguaucgAfuCfguucusgsu | ACAGAACGAUCGAUACAGAAACC | 4828 |
| AD-1222996.1 | A-2282371.1 | 2129 | gsasacgaUfcGfAfUfacagaaaccaL96 | A-2282372.1 | 2578 | VPusGfsguuUfcuguaucGfaUfcguucsusg | CAGAACGAUCGAUACAGAAACCA | 4829 |
| AD-1222997.1 | A-2282373.1 | 2130 | asascgauCfgAfUfAfcagaaaccaaL96 | A-2282374.1 | 2579 | VPusUfsgguUfucuguauCfgAfucguuscsu | AGAACGAUCGAUACAGAAACCAC | 4830 |
| AD-1222998.1 | A-2282375.1 | 2131 | ascsgaucGfaUfAfCfagaaaccacaL96 | A-2282376.1 | 2580 | VPusGfsuggUfuucuguaUfcGfaucgusus c | GAACGAUCGAUACAGAAACCACG | 4831 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1222999.1 | A-2282377.1 | 2132 | csgsaucgAfuAfCfAfgaaaccacgaL96 | A-2282378.1 | 2581 | VPusCfsgugGfuuucuguAfuCfgaucgsusu | AACGAUCGAUACAGAAACCACGC | 4832 |
| AD-1223000.1 | A-2282379.1 | 2133 | csasccauCfaCfCfAfucgacagaaaL96 | A-2282380.1 | 2582 | VPusUfsucuGfucgauggUfgAfuggugsusg | CACACCAUCACCAUCGACAGAAC | 4833 |
| AD-1223001.1 | A-2282381.1 | 2134 | csasucacCfaUfCfGfacagaacagaL96 | A-2282382.1 | 2583 | VPusCfsuguUfcugucgaUfgGfugaugsgsu | ACCAUCACCAUCGACAGAACAGU | 4834 |
| AD-1223002.1 | A-2282383.1 | 2135 | uscsaccaUfcGfAfCfagaacagucaL96 | A-2282384.1 | 2584 | VPusGfsacuGfuucugucGfaUfggugasusg | CAUCACCAUCGACAGAACAGUCC | 4835 |
| AD-1223003.1 | A-2282385.1 | 2136 | csasccauCfgAfCfAfgaacaguccaL96 | A-2282386.1 | 2585 | VPusGfsgacUfguucuguCfgAfuggugsasu | AUCACCAUCGACAGAACAGUCCU | 4836 |
| AD-1223004.1 | A-2282387.1 | 2137 | ascscaucGfaCfAfGfaacaguccuaL96 | A-2282388.1 | 2586 | VPusAfsggaCfuguucugUfcGfauggusgsa | UCACCAUCGACAGAACAGUCCUU | 4837 |
| AD-1223005.1 | A-2282389.1 | 2138 | cscsaucgAfcAfGfAfacaguccuuaL96 | A-2282390.1 | 2587 | VPusAfsaggAfcuguucuGfuCfgauggsusg | CACCAUCGACAGAACAGUCCUUA | 4838 |
| AD-1223006.1 | A-2282391.1 | 2139 | csasucgaCfaGfAfAfcaguccuuaaL96 | A-2282392.1 | 2588 | VPusUfsaagGfacuguucUfgUfcgaugsgsu | ACCAUCGACAGAACAGUCCUUAA | 4839 |
| AD-1223007.1 | A-2282393.1 | 2140 | asuscgacAfgAfAfCfaguccuuaaaL96 | A-2282394.1 | 2589 | VPusUfsuaaGfgacuguuCfuGfucgausgsg | CCAUCGACAGAACAGUCCUUAAU | 4840 |
| AD-1223008.1 | A-2282395.1 | 2141 | uscsgacaGfaAfCfAfguccuuaauaL96 | A-2282396.1 | 2590 | VPusAfsuuaAfggacuguUfcUfgucgasusg | CAUCGACAGAACAGUCCUUAAUC | 4841 |
| AD-1223009.1 | A-2282397.1 | 2142 | csgsacagAfaCfAfGfuccuuaaucaL96 | A-2282398.1 | 2591 | VPusGfsauuAfaggacugUfuCfugucgsasu | AUCGACAGAACAGUCCUUAAUCC | 4842 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1223010.1 | A-2282399.1 | 2143 | gsascagaAfcAfGfUfccuuaauccaL96 | A-2282400.1 | 2592 | VPusGfsgauUfaaggacuGfuUfcugucsgsa | UCGACAGAACAGUCCUUAAUCCA | 4843 |
| AD-1223011.1 | A-2282401.1 | 2144 | ascsagaaCfaGfUfCfcuuaauccaaL96 | A-2282402.1 | 2593 | VPusUfsggaUfuaaggacUfgUfucuguscsg | CGACAGAACAGUCCUUAAUCCAG | 4844 |
| AD-1223012.1 | A-2282403.1 | 2145 | asgsaacaGfuCfCfUfuaauccagaaL96 | A-2282404.1 | 2594 | VPusUfscugGfauuaaggAfcUfguucusgsu | ACAGAACAGUCCUUAAUCCAGAA | 4845 |
| AD-1223013.1 | A-2282405.1 | 2146 | gsasacagUfcCfUfUfaauccagaaaL96 | A-2282406.1 | 2595 | VPusUfsucuGfgauuaagGfaCfuguucsusg | CAGAACAGUCCUUAAUCCAGAAA | 4846 |
| AD-1223014.1 | A-2282407.1 | 2147 | asascaguCfcUfUfAfauccagaaaaL96 | A-2282408.1 | 2596 | VPusUfsuucUfggauuaaGfgAfcuguuscsu | AGAACAGUCCUUAAUCCAGAAAC | 4847 |
| AD-1223015.1 | A-2282409.1 | 2148 | ascsagucCfuUfAfAfuccagaaacaL96 | A-2282410.1 | 2597 | VPusGfsuuuCfuggauuaAfgGfacugusgsu | GAACAGUCCUUAAUCCAGAAACC | 4848 |
| AD-1223016.1 | A-2282411.1 | 2149 | csasguccUfuAfAfUfccagaaaccaL96 | A-2282412.1 | 2598 | VPusGfsguuUfcuggauuAfaGfgacugsusu | AACAGUCCUUAAUCCAGAAACCU | 4849 |
| AD-1223017.1 | A-2282413.1 | 2150 | asgsuccuUfaAfUfCfcagaaaccuaL96 | A-2282414.1 | 2599 | VPusAfsgguUfucuggauUfaAfggacusgsu | ACAGUCCUUAAUCCAGAAACCUG | 4850 |
| AD-1223018.1 | A-2282415.1 | 2151 | gsusccuuAfaUfCfCfagaaaccugaL96 | A-2282416.1 | 2600 | VPusCfsaggUfuucuggaUfuAfaggacsusg | CAGUCCUUAAUCCAGAAACCUGA | 4851 |
| AD-1223019.1 | A-2282417.1 | 2152 | uscscuuaAfuCfCfAfgaaaccugaaL96 | A-2282418.1 | 2601 | VPusUfscagGfuuucuggAfuUfaaggascsu | AGUCCUUAAUCCAGAAACCUGAA | 4852 |
| AD-1223020.1 | A-2282419.1 | 2153 | cscsuuaaUfcCfAfGfaaaccugaaaL96 | A-2282420.1 | 2602 | VPusUfsucaGfguuucugGfaUfuaaggsasc | GUCCUUAAUCCAGAAACCUGAAA | 4853 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-12230 21.1 | A-22824 21.1 | 2154 | csusuaauCfcAfGfAfaaccug aaaaL96 | A-228242 2.1 | 2603 | VPusUfsuucAfgguuucu GfgAfuuaagsgsa | UCCUUAAUCCAGAA ACCUGAAAU | 4854 |
| AD-12230 22.1 | A-22824 23.1 | 2155 | ususaaucCfaGfAfAfaccuga aauaL96 | A-228242 4.1 | 2604 | VPusAfsuuuCfagguuuc UfgGfauuaasgsg | CCUUAAUCCAGAAA CCUGAAAUG | 4855 |
| AD-12230 23.1 | A-22824 25.1 | 2156 | csasgaaaCfcUfGfAfaaugaa ggaaL96 | A-228242 6.1 | 2605 | VPusUfsccuUfcauuucaG fgUfuucugsgsa | UCCAGAAACCUGAA AUGAAGGAA | 4856 |
| AD-12230 24.1 | A-22824 27.1 | 2157 | asgsaaacCfuGfAfAfaugaag gaaaL96 | A-228242 8.1 | 2606 | VPusUfsuccUfucauuuc AfgGfuuucusgsg | CCAGAAACCUGAAA UGAAGGAAG | 4857 |
| AD-12230 25.1 | A-22824 29.1 | 2158 | gsasaaccUfgAfAfAfugaagg aagaL96 | A-228243 0.1 | 2607 | VPusCfsuucCfuucauuuC faGfguuucsusg | CAGAAACCUGAAAU GAAGGAAGA | 4858 |
| AD-12230 26.1 | A-22824 31.1 | 2159 | asasaccuGfaAfAfUfgaagga agaaL96 | A-228243 2.1 | 2608 | VPusUfscuuCfcuucauu UfcAfgguuuscsu | AGAAACCUGAAAUG AAGGAAGAG | 4859 |
| AD-12230 27.1 | A-22824 33.1 | 2160 | asasccugAfaAfUfGfaaggaa gagaL96 | A-228243 4.1 | 2609 | VPusCfsucuUfccuucauU fuCfagguusuṣc | GAAACCUGAAAUGA AGGAAGAGG | 4860 |
| AD-12230 28.1 | A-22824 35.1 | 2161 | cscsugaaAfuGfAfAfggaaga ggaaL96 | A-228243 6.1 | 2610 | VPusUfsccuCfuuccuucA fuUfucaggsusu | AACCUGAAAUGAAG GAAGAGGAG | 4861 |
| AD-12230 29.1 | A-22824 37.1 | 2162 | asusgaagGfaAfGfAfggagac ucuaL96 | A-228243 8.1 | 2611 | VPusAfsgagUfcuccucu UfcCfuucausus u | AAAUGAAGGAAGA GGAGACUCUG | 4862 |
| AD-12230 30.1 | A-22824 39.1 | 2163 | uscsccucUfuGfGfAfauugga uucaL96 | A-228244 0.1 | 2612 | VPusGfsaauCfcaauccA faGfagggascsc | GGUCCCUCUUGGAA UUGGAUUCG | 4863 |
| AD-12230 31.1 | A-22824 41.1 | 2164 | cscsucuuGfgAfAfUfuggauu cgcaL96 | A-228244 2.1 | 2613 | VPusGfscgaAfuccaauuC fcAfagaggsgsa | UCCCUCUUGGAAUU GGAUUCGCC | 4864 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1223032.1 | A-2282443.1 | 2165 | csuscuugGfaAfUfUfggauucgccaL96 | A-2282444.1 | 2614 | VPusGfsgcgAfauccaauUfcCfaagagsgsg | CCCUCUUGGAAUUGGAUUCGCCA | 4865 |
| AD-1223033.1 | A-2282445.1 | 2166 | ususggaaUfuGfGfAfuucgccauuaL96 | A-2282446.1 | 2615 | VPusAfsaugGfcgaauccAfaUfuccaasgsa | UCUUGGAAUUGGAUUCGCCAUUU | 4866 |
| AD-1223034.1 | A-2282447.1 | 2167 | usgsgaauUfgGfAfUfucgccauuuaL96 | A-2282448.1 | 2616 | VPusAfsaauGfgcgaaucCfaAfuuccasasg | CUUGGAAUUGGAUUCGCCAUUUU | 4867 |
| AD-1223035.1 | A-2282449.1 | 2168 | gsgsaauuGfgAfUfUfcgccauuuuaL96 | A-2282450.1 | 2617 | VPusAfsaaaUfggcgaauCfcAfauuccsasa | UUGGAAUUGGAUUCGCCAUUUUA | 4868 |
| AD-1223036.1 | A-2282451.1 | 2169 | gsasauugGfaUfUfCfgccauuuuaaL96 | A-2282452.1 | 2618 | VPusUfsaaaAfuggcgaaUfcCfaauucscsa | UGGAAUUGGAUUCGCCAUUUUAU | 4869 |
| AD-1223037.1 | A-2282453.1 | 2170 | asasuuggAfuUfCfGfccauuuuauaL96 | A-2282454.1 | 2619 | VPusAfsuaaAfauggcgaAfuCfcaauuscsc | GGAAUUGGAUUCGCCAUUUUAUU | 4870 |
| AD-1223038.1 | A-2282455.1 | 2171 | asusuggaUfuCfGfCfcauuuuauuaL96 | A-2282456.1 | 2620 | VPusAfsauaAfaauggcgAfaUfccaaususc | GAAUUGGAUUCGCCAUUUUAUUU | 4871 |
| AD-1223039.1 | A-2282457.1 | 2172 | ususggauUfcGfCfCfauuuuauuuaL96 | A-2282458.1 | 2621 | VPusAfsaauAfaaauggcGfaAfuccaasusu | AAUUGGAUUCGCCAUUUUAUUUU | 4872 |
| AD-1223040.1 | A-2282459.1 | 2173 | usgsgauuCfgCfCfAfuuuuauuuuaL96 | A-2282460.1 | 2622 | VPusAfsaaaUfaaaauggCfgAfauccasasu | AUUGGAUUCGCCAUUUUAUUUUU | 4873 |
| AD-1223041.1 | A-2282461.1 | 2174 | gsgsauucGfcCfAfUfuuuauuuuuaL96 | A-2282462.1 | 2623 | VPusAfsaaaAfuaaaaugGfcGfaauccsasa | UUGGAUUCGCCAUUUUAUUUUUC | 4874 |
| AD-1223042.1 | A-2282463.1 | 2175 | gsasuucgCfcAfUfUfuuauuuuucaL96 | A-2282464.1 | 2624 | VPusGfsaaaAfauaaaauGfgCfgaaucscsa | UGGAUUCGCCAUUUUAUUUUUCU | 4875 |

TABLE 8A-continued

| Exemplary Human VEGF-A siRNA Modified Single Strands and Duplex Sequences | | | | | | | | |
|---|---|---|---|---|---|---|---|---|
| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
| AD-1223043.1 | A-2282465.1 | 2176 | uscsgccaUfuUfUfAfuuuucuugaL96 | A-2282466.1 | 2625 | VPusCfsaagAfaaaauaaAfaUfggcgasasu | AUUCGCCAUUUUAUUUUCUUGC | 4876 |
| AD-1223044.1 | A-2282467.1 | 2177 | csgsccauUfuUfAfUfuuuucuugcaL96 | A-2282468.1 | 2626 | VPusGfscaaGfaaaaauaAfaAfuggcgsasa | UUCGCCAUUUUAUUUUCUUGCU | 4877 |
| AD-1223045.1 | A-2282469.1 | 2178 | gscscauuUfuAfUfUfuuucuugcuaL96 | A-2282470.1 | 2627 | VPusAfsgcaAfgaaaaauAfaAfauggcsgsa | UCGCCAUUUUAUUUUCUUGCUG | 4878 |
| AD-1223046.1 | A-2282471.1 | 2179 | cscsauuuUfaUfUfUfuucuugcugaL96 | A-2282472.1 | 2628 | VPusCfsagcAfagaaaaaUfaAfaauggcscsg | CGCCAUUUUAUUUUCUUGCUGC | 4879 |
| AD-1223047.1 | A-2282473.1 | 2180 | csasuuuuAfuUfUfUfucuugcugcaL96 | A-2282474.1 | 2629 | VPusGfscagCfaagaaaaAfuAfaaaugsgsc | GCCAUUUUAUUUUCUUGCUGCU | 4880 |
| AD-1223048.1 | A-2282475.1 | 2181 | asusuuuaUfuUfUfUfcuugcugcuaL96 | A-2282476.1 | 2630 | VPusAfsgcaGfcaagaaaAfaUfaaaausgsg | CCAUUUUAUUUUCUUGCUGCUA | 4881 |
| AD-1223049.1 | A-2282477.1 | 2182 | ususuuauUfuUfUfCfuugcugcuaaL96 | A-2282478.1 | 2631 | VPusUfsagcAfgcaagaaAfaAfuaaaasusg | CAUUUUAUUUUCUUGCUGCUAA | 4882 |
| AD-1223050.1 | A-2282479.1 | 2183 | ususucuuGfcUfGfCfuaaaucaccaL96 | A-2282480.1 | 2632 | VPusGfsgugAfuuuagcaGfcAfagaaasasa | UUUUUCUUGCUGCUAAAUCACCG | 4883 |
| AD-1223051.1 | A-2282481.1 | 2184 | uscsaccgAfgCfCfCfggaagauuaaL96 | A-2282482.1 | 2633 | VPusUfsaauCfuuccgggCfuCfggugasusu | AAUCACCGAGCCCGGAAGAUUAG | 4884 |
| AD-1223052.1 | A-2282483.1 | 2185 | gscsccggAfaGfAfUfuagagaguuaL96 | A-2282484.1 | 2634 | VPusAfsacuCfucuaaucUfuCfcgggcsusc | GAGCCCGGAAGAUUAGAGAGUUU | 4885 |
| AD-1223053.1 | A-2282485.1 | 2186 | cscscggaAfgAfUfUfagagaguuuaL96 | A-2282486.1 | 2635 | VPusAfsaacUfcucuaauCfuUfccgggscsu | AGCCCGGAAGAUUAGAGAGUUUU | 4886 |

TABLE 8A-continued

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| Exemplary Human VEGF-A siRNA Modified Single Strands and Duplex Sequences | | | | | | | | |
| AD-1223054.1 | A-2282487.1 | 2187 | csgsgaagAfuUfAfGfagaguuuuaaL96 | A-2282488.1 | 2636 | VPusUfsaaaAfcucucuaAfuCfuuccgsgsg | CCCGGAAGAUUAGAGAGUUUUAU | 4887 |
| AD-1223055.1 | A-2282489.1 | 2188 | gsgsaagaUfuAfGfAfgaguuuuauaL96 | A-2282490.1 | 2637 | VPusAfsuaaAfacucucuAfaUfcuuccsgsg | CCGGAAGAUUAGAGAGUUUUAUU | 4888 |
| AD-1223056.1 | A-2282491.1 | 2189 | gsasagauUfaGfAfGfaguuuuauuaL96 | A-2282492.1 | 2638 | VPusAfsauaAfaacucucUfaAfucuucscsg | CGGAAGAUUAGAGAGUUUUAUUU | 4889 |
| AD-1223057.1 | A-2282493.1 | 2190 | asasgauuAfgAfGfAfguuuuauuuaL96 | A-2282494.1 | 2639 | VPusAfsaauAfaaacucuCfuAfaucuuscsc | GGAAGAUUAGAGAGUUUUAUUUC | 4890 |
| AD-1223058.1 | A-2282495.1 | 2191 | asgsauuaGfaGfAfGfuuuuauuucaL96 | A-2282496.1 | 2640 | VPusGfsaaaUfaaaacucUfcUfaaucusuc | GAAGAUUAGAGAGUUUUAUUUCU | 4891 |
| AD-1223059.1 | A-2282497.1 | 2192 | asusuagaGfaGfUfUfuuauuucugaL96 | A-2282498.1 | 2641 | VPusCfsagaAfauaaaacUfcUfcuaauscsu | AGAUUAGAGAGUUUUAUUUCUGG | 4892 |
| AD-1223060.1 | A-2282499.1 | 2193 | ususagagAfgUfUfUfuauuucuggaL96 | A-2282500.1 | 2642 | VPusCfscagAfaauaaaaCfuCfucuaasusc | GAUUAGAGAGUUUUAUUUCUGGG | 4893 |
| AD-1223061.1 | A-2282501.1 | 2194 | usasgagaGfuUfUfUfauuucugggaL96 | A-2282502.1 | 2643 | VPusCfsccaGfaaauaaaAfcUfcucuasasu | AUUAGAGAGUUUUAUUUCUGGGA | 4894 |
| AD-1223062.1 | A-2282503.1 | 2195 | asgsagagUfuUfUfAfuuucugggaaL96 | A-2282504.1 | 2644 | VPusUfscccAfgaaauaaAfaCfucucusasa | UUAGAGAGUUUUAUUUCUGGGAU | 4895 |
| AD-1223063.1 | A-2282505.1 | 2196 | gsasgaguUfuUfAfUfuucugggauaL96 | A-2282506.1 | 2645 | VPusAfsuccCfagaaauaAfaAfcucucsusa | UAGAGAGUUUUAUUUCUGGGAUU | 4896 |
| AD-1223064.1 | A-2282507.1 | 2197 | asgsaguuUfuAfUfUfucugggauuaL96 | A-2282508.1 | 2646 | VPusAfsaucCfcagaaauAfaAfacucuscsu | AGAGAGUUUUAUUUCUGGGAUUC | 4897 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1223065.1 | A-2282509.1 | 2198 | gsasguuuUfaUfUfUfcuggga uucaL96 | A-2282510.1 | 2647 | VPusGfsaauCfccagaaaU faAfaacucsusc | GAGAGUUUUAUUUC UGGGAUUCC | 4898 |
| AD-1223066.1 | A-2282511.1 | 2199 | asgsuuuuAfuUfUfCfuggga uuccaL96 | A-2282512.1 | 2648 | VPusGfsgaaUfcccagaaA fuAfaaacuscsu | AGAGUUUUAUUUCU GGGAUUCCU | 4899 |
| AD-1223067.1 | A-2282513.1 | 2200 | gsusuuuaUfuUfCfUfgggau uccuaL96 | A-2282514.1 | 2649 | VPusAfsggaAfucccagaA faUfaaaacsusc | GAGUUUUAUUUCUG GGAUUCCUG | 4900 |
| AD-1223068.1 | A-2282515.1 | 2201 | ususuuauUfuCfUfGfggauuc cugaL96 | A-2282516.1 | 2650 | VPusCfsaggAfaucccagA faAfuaaaascsu | AGUUUUAUUUCUGG GAUUCCUGU | 4901 |
| AD-1223069.1 | A-2282517.1 | 2202 | ususuauuUfcUfGfGfgauucc uguaL96 | A-2282518.1 | 2651 | VPusAfscagGfaaucccaG faAfauaaasasc | GUUUUAUUUCUGGG AUUCCUGUA | 4902 |
| AD-1223070.1 | A-2282519.1 | 2203 | ususauuuCfuGfGfGfauuccu guaaL96 | A-2282520.1 | 2652 | VPusUfsacaGfgaaucccA fgAfaauaasasa | UUUUAUUUCUGGGA UUCCUGUAG | 4903 |
| AD-1223071.1 | A-2282521.1 | 2204 | usasuuucUfgGfGfAfuuccug uagaL96 | A-2282522.1 | 2653 | VPusCfsuacAfggaauccC faGfaaauasasa | UUUAUUUCUGGGAU UCCUGUAGA | 4904 |
| AD-1223072.1 | A-2282523.1 | 2205 | asusuucuGfgGfAfUfuccugu agaaL96 | A-2282524.1 | 2654 | VPusUfscuaCfaggaaucC fcAfgaaausasa | UUAUUUCUGGGAUU CCUGUAGAC | 4905 |
| AD-1223073.1 | A-2282525.1 | 2206 | usuşucugGfgAfUfUfccugua gacaL96 | A-2282526.1 | 2655 | VPusGfsucuAfcaggaauC fcCfagaaasusa | UAUUUCUGGGAUUC CUGUAGACA | 4906 |
| AD-1223074.1 | A-2282527.1 | 2207 | uscsugggAfuUfCfCfuguaga cacaL96 | A-2282528.1 | 2656 | VPusGfsuguCfuacagga AfuCfccagasasa | UUUCUGGGAUUCCU GUAGACACA | 4907 |
| AD-1223075.1 | A-2282529.1 | 2208 | csusgggaUfuCfCfUfguagac acaaL96 | A-2282530.1 | 2657 | VPusUfsgugUfcuacagg AfaUfcccagsasa | UUCUGGGAUUCCUG UAGACACAC | 4908 |

TABLE 8A-continued

| Exemplary Human VEGF-A siRNA Modified Single Strands and Duplex Sequences | | | | | | | | |
|---|---|---|---|---|---|---|---|---|
| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
| AD-1223076.1 | A-2282531.1 | 2209 | usgsggauUfcCfUfGfuagacacacaL96 | A-2282532.1 | 2658 | VPusGfsuguGfucuacagGfaAfucccasgsa | UCUGGGAUUCCUGUAGACACACC | 4909 |
| AD-1223077.1 | A-2282533.1 | 2210 | gsgsgauuCfcUfGfUfagacacaccaL96 | A-2282534.1 | 2659 | VPusGfsgugUfgucuacaGfgAfaucccsasg | CUGGGAUUCCUGUAGACACACCC | 4910 |
| AD-1223078.1 | A-2282535.1 | 2211 | ascsacacCfcAfCfCfcacauacauaL96 | A-2282536.1 | 2660 | VPusAfsuguAfugugggguGfgGfuguguscsu | AGACACACCCACCCACAUACAUA | 4911 |
| AD-1223079.1 | A-2282537.1 | 2212 | ascscca cCfcAfCfAfuacauacauaL96 | A-2282538.1 | 2661 | VPusAfsuguAfuguaugu GfgGfugggusgsu | ACACCCACCCACAUACAUACAUU | 4912 |
| AD-1223080.1 | A-2282539.1 | 2213 | cscscaccCfaCfAfUfacauacauuaL96 | A-2282540.1 | 2662 | VPusAfsaugUfauguaugUfgGfugggsusg | CACCCACCCACAUACAUACAUUU | 4913 |
| AD-1223081.1 | A-2282541.1 | 2214 | cscsacccAfcAfUfAfcauacauuuaL96 | A-2282542.1 | 2663 | VPusAfsaauGfuauguauGfuGfgguggsgsu | ACCCACCCACAUACAUACAUUUA | 4914 |
| AD-1223082.1 | A-2282543.1 | 2215 | csascccaCfaUfAfCfauacauuuaaL96 | A-2282544.1 | 2664 | VPusUfsaaaUfguauguaUfgUfgggugsgsg | CCCACCCACAUACAUACAUUUAU | 4915 |
| AD-1223083.1 | A-2282545.1 | 2216 | cscsacauAfcAfUfAfcauuuauauaL96 | A-2282546.1 | 2665 | VPusAfsuauAfaauguauGfuAfuguggsgsu | ACCCACAUACAUACAUUUAUAUA | 4916 |
| AD-1223084.1 | A-2282547.1 | 2217 | csascauaCfaUfAfCfauuuauauaaL96 | A-2282548.1 | 2666 | VPusUfsauaUfaaauguaUfgUfaugugsgsg | CCCACAUACAUACAUUUAUAUAU | 4917 |
| AD-1223085.1 | A-2282549.1 | 2218 | ususaaauUfaAfCfAfgugcuaaugaL96 | A-2282550.1 | 2667 | VPusCfsauuAfgcacuguUfaAfuuuaasasa | UUUUAAAUUAACAGUGCUAAUGU | 4918 |
| AD-1223086.1 | A-2282551.1 | 2219 | usasaauuAfaCfAfGfugcuaauguaL96 | A-2282552.1 | 2668 | VPusAfscauUfagcacugUfuAfauuuasasa | UUUAAAUUAACAGUGCUAAUGUU | 4919 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1223087.1 | A-2282553.1 | 2220 | asasauuaAfcAfGfUfgcuaauguuaL96 | A-2282554.1 | 2669 | VPusAfsacaUfuagcacuGfuUfaauuusasa | UUAAAUUAACAGUGCUAAUGUUA | 4920 |
| AD-1223088.1 | A-2282555.1 | 2221 | asasuuaaCfaGfUfGfcuaauguuaaL96 | A-2282556.1 | 2670 | VPusUfsaacAfuuagcacUfgUfuaauusasa | UAAAUUAACAGUGCUAAUGUUAU | 4921 |
| AD-1223089.1 | A-2282557.1 | 2222 | asusuaacAfgUfGfCfuaauguuauaL96 | A-2282558.1 | 2671 | VPusAfsuaaCfauuagcaCfuGfuuaausus u | AAAUUAACAGUGCUAAUGUUAUU | 4922 |
| AD-1223090.1 | A-2282559.1 | 2223 | ususaacaGfuGfCfUfaauguuauuaL96 | A-2282560.1 | 2672 | VPusAfsauaAfcauuagcAfcUfguuaasusu | AAUUAACAGUGCUAAUGUUAUUG | 4923 |
| AD-1223091.1 | A-2282561.1 | 2224 | usasacagUfgCfUfAfauguuauugaL96 | A-2282562.1 | 2673 | VPusCfsaauAfacauuagCfaCfuguuasasu | AUUAACAGUGCUAAUGUUAUUGG | 4924 |
| AD-1223092.1 | A-2282563.1 | 2225 | asascaguGfcUfAfAfuguuauuggaL96 | A-2282564.1 | 2674 | VPusCfscaaUfaacauuaGfcAfcuguusasa | UUAACAGUGCUAAUGUUAUUGGU | 4925 |
| AD-1223093.1 | A-2282565.1 | 2226 | ascsagugCfuAfAfUfguuauugguaL96 | A-2282566.1 | 2675 | VPusAfsccaAfuaacauuAfgCfacugusus a | UAACAGUGCUAAUGUUAUUGGUG | 4926 |
| AD-1223094.1 | A-2282567.1 | 2227 | csasgugcUfaAfUfGfuuauuggugaL96 | A-2282568.1 | 2676 | VPusCfsaccAfauaacauUfaGfcacugsusu | AACAGUGCUAAUGUUAUUGGUGU | 4927 |
| AD-1223095.1 | A-2282569.1 | 2228 | gsusgcuaAfuGfUfUfauuggugucaL96 | A-2282570.1 | 2677 | VPusGfsacaCfcaauaacAfuUfagcacsusg | CAGUGCUAAUGUUAUUGGUGUCU | 4928 |
| AD-1223096.1 | A-2282571.1 | 2229 | usgscuaaUfgUfUfAfuuggugucuaL96 | A-2282572.1 | 2678 | VPusAfsgacAfccaauaaCfaUfuagcascsu | AGUGCUAAUGUUAUUGGUGUCUU | 4929 |
| AD-1223097.1 | A-2282573.1 | 2230 | gscsuaauGfuUfAfUfuggugucuuaL96 | A-2282574.1 | 2679 | VPusAfsagaCfaccaauaAfcAfuuagcsasc | GUGCUAAUGUUAUUGGUGUCUUC | 4930 |

TABLE 8A-continued

| Exemplary Human VEGF-A siRNA Modified Single Strands and Duplex Sequences | | | | | | | | |
|---|---|---|---|---|---|---|---|---|
| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
| AD-1223098.1 | A-2282575.1 | 2231 | csusaaugUfuAfUfUfgguguc uucaL96 | A-2282576.1 | 2680 | VPusGfsaagAfcaccaauA faCfauuagscsa | UGCUAAUGUUAUUG GUGUCUUCA | 4931 |
| AD-1223099.1 | A-2282577.1 | 2232 | usasauguUfaUfUfGfgugucu ucaaL96 | A-2282578.1 | 2681 | VPusUfsgaaGfacaccaaU faAfcauuasgsc | GCUAAUGUUAUUGG UGUCUUCAC | 4932 |
| AD-1223100.1 | A-2282579.1 | 2233 | asasuguuAfuUfGfGfugucu ucacaL96 | A-2282580.1 | 2682 | VPusGfsugaAfgacaccaA fuAfacauusasg | CUAAUGUUAUUGGU GUCUUCACU | 4933 |
| AD-1223101.1 | A-2282581.1 | 2234 | asusguuaUfuGfGfUfgucuuc acuaL96 | A-2282582.1 | 2683 | VPusAfsgugAfagacaccA faUfaacaususa | UAAUGUUAUUGGU GUCUUCACUG | 4934 |
| AD-1223102.1 | A-2282583.1 | 2235 | usgsuuauUfgGfUfGfucuuca cugaL96 | A-2282584.1 | 2684 | VPusCfsaguGfaagacacC faAfuaacasusu | AAUGUUAUUGGUG UCUUCACUGG | 4935 |
| AD-1223103.1 | A-2282585.1 | 2236 | gsusuauuGfgUfGfUfcuucac uggaL96 | A-2282586.1 | 2685 | VPusCfscagUfgaagacaC fcAfauaacsasu | AUGUUAUUGGUGUC UUCACUGGA | 4936 |
| AD-1223104.1 | A-2282587.1 | 2237 | ususauugGfuGfUfCfuucacu ggaaL96 | A-2282588.1 | 2686 | VPusUfsccaGfugaagacA fcCfaauaascsa | UGUUAUUGGUGUCU UCACUGGAU | 4937 |
| AD-1223105.1 | A-2282589.1 | 2238 | usgsguguCfuUfCfAfcuggau guaaL96 | A-2282590.1 | 2687 | VPusUfsacaUfccagugaA fgAfcaccasasu | AUUGGUGUCUUCAC UGGAUGUAU | 4938 |
| AD-1223106.1 | A-2282591.1 | 2239 | usgsucuuCfaCfUfGfgaugua uuuaL96 | A-2282592.1 | 2688 | VPusAfsaauAfcauccagU fgAfagacascsc | GGUGUCUUCACUGG AUGUAUUUG | 4939 |
| AD-1223107.1 | A-2282593.1 | 2240 | csascuggAfuGfUfAfuuugac ugcaL96 | A-2282594.1 | 2689 | VPusGfscagUfcaaauacA fuCfcagugsasa | UUCACUGGAUGUAU UUGACUGCU | 4940 |
| AD-1223108.1 | A-2282595.1 | 2241 | ascsuggaUfgUfAfUfuugacu gcuaL96 | A-2282596.1 | 2690 | VPusAfsgcaGfucaaauaC faUfccagusgsa | UCACUGGAUGUAUU UGACUGCUG | 4941 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1223109.1 | A-2282597.1 | 2242 | usgsgaugUfaUfUfUfgacugcuguaL96 | A-2282598.1 | 2691 | VPusAfscagCfagucaaaUfaCfauccasgsu | ACUGGAUGUAUUUGACUGCUGUG | 4942 |
| AD-1223110.1 | A-2282599.1 | 2243 | usasuuugAfcUfGfCfuguggacuuaL96 | A-2282600.1 | 2692 | VPusAfsaguCfcacagcaGfuCfaaauascsa | UGUAUUUGACUGCUGUGGACUUG | 4943 |
| AD-1223111.1 | A-2282601.1 | 2244 | ususugacUfgCfUfGfuggacuugaaL96 | A-2282602.1 | 2693 | VPusUfscaaGfuccacagCfaGfucaaasusa | UAUUUGACUGCUGUGGACUUGAG | 4944 |
| AD-1223112.1 | A-2282603.1 | 2245 | gscsugugGfaCfUfUfgaguugggaaL96 | A-2282604.1 | 2694 | VPusUfscccAfacucaagUfcCfacagcsasg | CUGCUGUGGACUUGAGUUGGGAG | 4945 |
| AD-1223113.1 | A-2282605.1 | 2246 | uscsccacUfcAfGfAfuccugacagaL96 | A-2282606.1 | 2695 | VPusCfsuguCfaggaucuGfaGfugggasasc | GUUCCCACUCAGAUCCUGACAGG | 4946 |
| AD-1223114.1 | A-2282607.1 | 2247 | cscscacuCfaGfAfUfccugacaggaL96 | A-2282608.1 | 2696 | VPusCfscugUfcaggaucUfgAfgugggsasa | UUCCCACUCAGAUCCUGACAGGG | 4947 |
| AD-1223115.1 | A-2282609.1 | 2248 | gsgsaggaGfaUfGfAfgagacucugaL96 | A-2282610.1 | 2697 | VPusCfsagaGfucucucaUfcUfccuccsusc | GAGGAGGAGAUGAGAGACUCUGG | 4948 |
| AD-1223116.1 | A-2282611.1 | 2249 | gsasggagAfuGfAfGfagacucuggaL96 | A-2282612.1 | 2698 | VPusCfscagAfgucucucAfuCfuccucscsu | AGGAGGAGAUGAGAGACUCUGGC | 4949 |
| AD-1223117.1 | A-2282613.1 | 2250 | gsgsagauGfaGfAfGfacucuggcaaL96 | A-2282614.1 | 2699 | VPusUfsgccAfgagucucUfcAfucuccsusc | GAGGAGAUGAGAGACUCUGGCAU | 4950 |
| AD-1223118.1 | A-2282615.1 | 2251 | gsasgacuCfuGfGfCfaugaucuuuaL96 | A-2282616.1 | 2700 | VPusAfsaagAfucaugccAfgAfgucucsusc | GAGAGACUCUGGCAUGAUCUUUU | 4951 |
| AD-1223119.1 | A-2282617.1 | 2252 | asgsacucUfgGfCfAfugaucuuuuaL96 | A-2282618.1 | 2701 | VPusAfsaaaGfaucaugcCfaGfagucuscsu | AGAGACUCUGGCAUGAUCUUUUU | 4952 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1223120.1 | A-2282619.1 | 2253 | ususuuggGfaAfCfAfccgacaaacaL96 | A-2282620.1 | 2702 | VPusGfsuuuGfucggugu UfcCfcaaaascsu | AGUUUUGGGAACAC CGACAAACC | 4953 |
| AD-1223121.1 | A-2282621.1 | 2254 | gsasgcuuCfaGfGfAfcauugcuguaL96 | A-2282622.1 | 2703 | VPusAfscagCfaauguccU fgAfagcucscsc | GGGAGCUUCAGGAC AUUGCUGUG | 4954 |
| AD-1223122.1 | A-2282623.1 | 2255 | gscsuucaGfgAfCfAfuugcugugcaL96 | A-2282624.1 | 2704 | VPusGfscacAfgcaauguC fcUfgaagcsusc | GAGCUUCAGGACAU UGCUGUGCU | 4955 |
| AD-1223123.1 | A-2282625.1 | 2256 | csusucagGfaCfAfUfugcugugcuaL96 | A-2282626.1 | 2705 | VPusAfsgcaCfagcaaugU fcCfugaagscsu | AGCUUCAGGACAUU GCUGUGCUU | 4956 |
| AD-1223124.1 | A-2282627.1 | 2257 | ususcaggAfcAfUfUfgcugugcuuaL96 | A-2282628.1 | 2706 | VPusAfsagcAfcagcaauG fuCfcugaasgsc | GCUUCAGGACAUUG CUGUGCUUU | 4957 |
| AD-1223125.1 | A-2282629.1 | 2258 | uscsaggaCfaUfUfGfcugugcuuuaL96 | A-2282630.1 | 2707 | VPusAfsaagCfacagcaaU fgUfccugasasg | CUUCAGGACAUUGC UGUGCUUUG | 4958 |
| AD-1223126.1 | A-2282631.1 | 2259 | csasggacAfuUfGfCfugugcuuugaL96 | A-2282632.1 | 2708 | VPusCfsaaaGfcacagcaA fuGfuccugsasa | UUCAGGACAUUGCU GUGCUUUGG | 4959 |
| AD-1223127.1 | A-2282633.1 | 2260 | csgscuuaCfuCfUfCfaccugcuucaL96 | A-2282634.1 | 2709 | VPusGfsaagCfaggugag AfgUfaagcgsasa | UUCGCUUACUCUCA CCUGCUUCU | 4960 |
| AD-1223128.1 | A-2282635.1 | 2261 | gscsuuacUfcUfCfAfccugcuucuaL96 | A-2282636.1 | 2710 | VPusAfsgaaGfcagguga GfaGfuaagcsgsa | UCGCUUACUCUCAC CUGCUUCUG | 4961 |
| AD-1223129.1 | A-2282637.1 | 2262 | ususacucUfcAfCfCfugcuucugaaL96 | A-2282638.1 | 2711 | VPusUfscagAfagcaggu GfaGfaguaasgsc | GCUUACUCUCACCU GCUUCUGAG | 4962 |
| AD-1223130.1 | A-2282639.1 | 2263 | csuscucaCfcUfGfCfuucugaguuaL96 | A-2282640.1 | 2712 | VPusAfsacuCfagaagcaG fgUfgagagsusa | UACUCUCACCUGCU UCUGAGUUG | 4963 |

TABLE 8A-continued

| Exemplary Human VEGF-A siRNA Modified Single Strands and Duplex Sequences | | | | | | | | |
|---|---|---|---|---|---|---|---|---|
| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
| AD-1223131.1 | A-2282641.1 | 2264 | uscsucacCfuGfCfUfucugaguugaL96 | A-2282642.1 | 2713 | VPusCfsaacUfcagaagcAfgGfugagasgsu | ACUCUCACCUGCUUCUGAGUUGC | 4964 |
| AD-1223132.1 | A-2282643.1 | 2265 | csuscaccUfgCfUfUfcugaguugcaL96 | A-2282644.1 | 2714 | VPusGfscaaCfucagaagCfaGfgugagsasg | CUCUCACCUGCUUCUGAGUUGCC | 4965 |
| AD-1223133.1 | A-2282645.1 | 2266 | uscsaccuGfcUfUfCfugaguugccaL96 | A-2282646.1 | 2715 | VPusGfsgcaAfcucagaaGfcAfggugasgsa | UCUCACCUGCUUCUGAGUUGCCC | 4966 |
| AD-1223134.1 | A-2282647.1 | 2267 | csasccugCfuUfCfUfgaguugcccaL96 | A-2282648.1 | 2716 | VPusGfsggcAfacucagaAfgCfaggugsasg | CUCACCUGCUUCUGAGUUGCCCA | 4967 |
| AD-1223135.1 | A-2282649.1 | 2268 | ascscugcUfuCfUfGfaguugcccaaL96 | A-2282650.1 | 2717 | VPusUfsgggCfaacucagAfaGfcaggusgsa | UCACCUGCUUCUGAGUUGCCCAG | 4968 |
| AD-1223136.1 | A-2282651.1 | 2269 | cscsugcuUfcUfGfAfguugcccagaL96 | A-2282652.1 | 2718 | VPusCfsuggGfcaacucaGfaAfgcaggsusg | CACCUGCUUCUGAGUUGCCCAGG | 4969 |
| AD-1223137.1 | A-2282653.1 | 2270 | csgsgcgaAfgAfGfAfagagacacaaL96 | A-2282654.1 | 2719 | VPusUfsgugUfcucuucuCfuUfcgccgsgsg | CCCGGCGAAGAGAAGAGACACAU | 4970 |
| AD-1223138.1 | A-2282655.1 | 2271 | gsgscgaaGfaGfAfAfgagacacauaL96 | A-2282656.1 | 2720 | VPusAfsuguGfucucuucUfcUfucgccsgsg | CCGGCGAAGAGAAGAGACACAUU | 4971 |
| AD-1223139.1 | A-2282657.1 | 2272 | gscsgaagAfgAfAfGfagacacauuaL96 | A-2282658.1 | 2721 | VPusAfsaugUfgucucuuCfuCfuucgcscsg | CGGCGAAGAGAAGAGACACAUUG | 4972 |
| AD-1223140.1 | A-2282659.1 | 2273 | csgsaagaGfaAfGfAfgacacauugaL96 | A-2282660.1 | 2722 | VPusCfsaauGfugucucuUfcUfcuucgscsc | GGCGAAGAGAAGAGACACAUUGU | 4973 |
| AD-1223141.1 | A-2282661.1 | 2274 | gsasagagAfaGfAfGfacacauuguaL96 | A-2282662.1 | 2723 | VPusAfscaaUfgugucucUfuCfucuucsgsc | GCGAAGAGAAGAGACACAUUGUU | 4974 |

TABLE 8A-continued

| Exemplary Human VEGF-A siRNA Modified Single Strands and Duplex Sequences | | | | | | | | |
|---|---|---|---|---|---|---|---|---|
| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
| AD-1223142.1 | A-2282663.1 | 2275 | asasgagaAfgAfGfAfcacauuguuaL96 | A-2282664.1 | 2724 | VPusAfsacaAfugugucuCfuUfcucuuscsg | CGAAGAGAAGAGACACAUUGUUG | 4975 |
| AD-1223143.1 | A-2282665.1 | 2276 | asgsagaaGfaGfAfCfacauuguugaL96 | A-2282666.1 | 2725 | VPusCfsaacAfaugugucUfcUfucucusuc | GAAGAGAAGAGACACAUUGUUGG | 4976 |
| AD-1223144.1 | A-2282667.1 | 2277 | gsasgaagAfgAfCfAfcauuguuggaL96 | A-2282668.1 | 2726 | VPusCfscaaCfaauguguCfuCfuucucsusu | AAGAGAAGAGACACAUUGUUGGA | 4977 |
| AD-1223145.1 | A-2282669.1 | 2278 | asgsaagaGfaCfAfCfauuguuggaaL96 | A-2282670.1 | 2727 | VPusUfsccaAfcaaugugUfcUfcuucuscsu | AGAGAAGAGACACAUUGUUGGAA | 4978 |
| AD-1223146.1 | A-2282671.1 | 2279 | gsasagagAfcAfCfAfuuguuggaaaL96 | A-2282672.1 | 2728 | VPusUfsuccAfacaauguGfuCfucuucsusc | GAGAAGAGACACAUUGUUGGAAG | 4979 |
| AD-1223147.1 | A-2282673.1 | 2280 | asasgagaCfaCfAfUfuguuggaagaL96 | A-2282674.1 | 2729 | VPusCfsuucCfaacaaugUfgUfcucuuscsu | AGAAGAGACACAUUGUUGGAAGA | 4980 |
| AD-1223148.1 | A-2282675.1 | 2281 | asgsagacAfcAfUfUfguuggaagaaL96 | A-2282676.1 | 2730 | VPusUfscuuCfcaacaauGfuGfucucusuc | GAAGAGACACAUUGUUGGAAGAA | 4981 |
| AD-1223149.1 | A-2282677.1 | 2282 | gsasgacaCfaUfUfGfuuggaagaaaL96 | A-2282678.1 | 2731 | VPusUfsucuUfccaacaaUfgUfgucucsusu | AAGAGACACAUUGUUGGAAGAAG | 4982 |
| AD-1223150.1 | A-2282679.1 | 2283 | asgsacacAfuUfGfUfuggaagaagaL96 | A-2282680.1 | 2732 | VPusCfsuucUfuccaacaAfuGfugucuscsu | AGAGACACAUUGUUGGAAGAAGC | 4983 |
| AD-1223151.1 | A-2282681.1 | 2284 | gsascacaUfuGfUfUfggaagaagcaL96 | A-2282682.1 | 2733 | VPusGfscuuCfuuccaacAfaUfgugucsusc | GAGACACAUUGUUGGAAGAAGCA | 4984 |
| AD-1223152.1 | A-2282683.1 | 2285 | ascsacauUfgUfUfGfgaagaagcaaL96 | A-2282684.1 | 2734 | VPusUfsgcuUfcuuccaaCfaAfugugusesu | AGACACAUUGUUGGAAGAAGCAG | 4985 |

TABLE 8A-continued

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| Exemplary Human VEGF-A siRNA Modified Single Strands and Duplex Sequences | | | | | | | | |
| AD-1223153.1 | A-2282685.1 | 2286 | csascauuGfuUfGfGfaagaagcagaL96 | A-2282686.1 | 2735 | VPusCfsugcUfucuuccaAfcAfaugugsusc | GACACAUUGUUGGAAGAAGCAGC | 4986 |
| AD-1223154.1 | A-2282687.1 | 2287 | usasugucCfuCfAfCfaccauugaaaL96 | A-2282688.1 | 2736 | VPusUfsucaAfuggugugAfgGfacauasgsg | CCUAUGUCCUCACACCAUUGAAA | 4987 |
| AD-1223155.1 | A-2282689.1 | 2288 | uscscucaCfaCfCfAfuugaaaccaaL96 | A-2282690.1 | 2737 | VPusUfsgguUfucaauggUfgUfgaggascsa | UGUCCUCACACCAUUGAAACCAC | 4988 |
| AD-1223156.1 | A-2282691.1 | 2289 | cscsucacAfcCfAfUfugaaaccacaL96 | A-2282692.1 | 2738 | VPusGfsuggUfuucaaugGfuGfugaggsasc | GUCCUCACACCAUUGAAACCACU | 4989 |
| AD-1223157.1 | A-2282693.1 | 2290 | csuscacaCfcAfUfUfgaaaccacuaL96 | A-2282694.1 | 2739 | VPusAfsgugGfuuucaauGfgUfgugagsgsa | UCCUCACACCAUUGAAACCACUA | 4990 |
| AD-1223158.1 | A-2282695.1 | 2291 | uscsacacCfaUfUfGfaaaccacuaaL96 | A-2282696.1 | 2740 | VPusUfsaguGfguuucaaUfgGfugugasgsg | CCUCACACCAUUGAAACCACUAG | 4991 |
| AD-1223159.1 | A-2282697.1 | 2292 | csascaccAfuUfGfAfaaccacuagaL96 | A-2282698.1 | 2741 | VPusCfsuagUfgguuucaAfuGfgugugsasg | CUCACACCAUUGAAACCACUAGU | 4992 |
| AD-1223160.1 | A-2282699.1 | 2293 | cscsauugAfaAfCfCfacuaguucuaL96 | A-2282700.1 | 2742 | VPusAfsgaaCfuagugguUfuCfaauggsusg | CACCAUUGAAACCACUAGUUCUG | 4993 |
| AD-1223161.1 | A-2282701.1 | 2294 | csasuugaAfaCfCfAfcuaguucugaL96 | A-2282702.1 | 2743 | VPusCfsagaAfcuaguggUfuUfcaaugsgsu | ACCAUUGAAACCACUAGUUCUGU | 4994 |
| AD-1223162.1 | A-2282703.1 | 2295 | asusugaaAfcCfAfCfuaguucuguaL96 | A-2282704.1 | 2744 | VPusAfscagAfacuagugGfuUfucaausgsg | CCAUUGAAACCACUAGUUCUGUC | 4995 |
| AD-1223163.1 | A-2282705.1 | 2296 | ususgaaaCfAfCfUfaguucugucaL96 | A-2282706.1 | 2745 | VPusGfsacaGfaacuaguGfgUfuucaasusg | CAUUGAAACCACUAGUUCUGUCC | 4996 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1223164.1 | A-2282707.1 | 2297 | usgsaaacCfaCfUfAfguucuguccaL96 | A-2282708.1 | 2746 | VPusGfsgacAfgaacuagUfgGfuuucasasu | AUUGAAACCACUAGUUCUGUCCC | 4997 |
| AD-1223165.1 | A-2282709.1 | 2298 | gsasccugGfuUfGfUfgugugugugaL96 | A-2282710.1 | 2747 | VPusCfsacaCfacacacaAfcCfaggucsusc | GAGACCUGGUUGUGUGUGUGUGA | 4998 |
| AD-1223166.1 | A-2282711.1 | 2299 | ascscuggUfuGfUfGfugugugugaaL96 | A-2282712.1 | 2748 | VPusUfscacAfcacacacAfaCfcagguscsu | AGACCUGGUUGUGUGUGUGUGAG | 4999 |
| AD-1223167.1 | A-2282713.1 | 2300 | cscsugguUfgUfGfUfgugugugagaL96 | A-2282714.1 | 2749 | VPusCfsucaCfacacacaCfaAfccaggsusc | GACCUGGUUGUGUGUGUGUGAGU | 5000 |
| AD-1223168.1 | A-2282715.1 | 2301 | csusgguuGfuGfUfGfugugugaguaL96 | A-2282716.1 | 2750 | VPusAfscucAfcacacacAfcAfaccagsgsu | ACCUGGUUGUGUGUGUGUGAGUG | 5001 |
| AD-1223169.1 | A-2282717.1 | 2302 | usgsguugUfgUfGfUfgugugagugaL96 | A-2282718.1 | 2751 | VPusCfsacuCfacacacaCfaCfaaccasgsg | CCUGGUUGUGUGUGUGUGAGUGG | 5002 |
| AD-1223170.1 | A-2282719.1 | 2303 | gsgsuuguGfuGfUfGfugugaguggaL96 | A-2282720.1 | 2752 | VPusCfscacUfcacacacAfcAfcaaccsasg | CUGGUUGUGUGUGUGUGAGUGGU | 1914 |
| AD-1223171.1 | A-2282721.1 | 2304 | gsusguguGfuGfUfGfaguggUugaaL96 | A-2282722.1 | 2753 | VPusUfscaaCfcacucacAfcAfcacacsasa | UUGUGUGUGUGUGAGUGGUUGAC | 1915 |
| AD-1223172.1 | A-2282723.1 | 2305 | usgsugugUfgUfGfAfguggugugacaL96 | A-2282724.1 | 2754 | VPusGfsucaAfccacucaCfaCfacacascsa | UGUGUGUGUGUGAGUGGUUGACC | 1916 |
| AD-1223173.1 | A-2282725.1 | 2306 | usgsugugUfgAfGfUfgguugaccuaL96 | A-2282726.1 | 2755 | VPusAfsgguCfaaccacuCfaCfacacascsa | UGUGUGUGUGAGUGGUUGACCUU | 1917 |
| AD-1223174.1 | A-2282727.1 | 2307 | usgsugugAfgUfGfGfuugaccuucaL96 | A-2282728.1 | 2756 | VPusGfsaagGfucaaccaCfuCfacacascsa | UGUGUGUGAGUGGUUGACCUUCC | 1918 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1223175.1 | A-2282729.1 | 2308 | gsusgugaGfuGfGfUfugaccuuccaL96 | A-2282730.1 | 2757 | VPusGfsgaaGfgucaaccAfcUfcacacsasc | GUGUGUGAGUGGUUGACCUUCCU | 1919 |
| AD-1223176.1 | A-2282731.1 | 2309 | usgsugagUfgGfUfUfgaccuuccuaL96 | A-2282732.1 | 2758 | VPusAfsggaAfggucaacCfaCfucacascsa | UGUGUGAGUGGUUGACCUUCCUC | 1920 |
| AD-1223177.1 | A-2282733.1 | 2310 | usgsagugGfuUfGfAfccuuccuccaL96 | A-2282734.1 | 2759 | VPusGfsgagGfaaggucaAfcCfacucascsa | UGUGAGUGGUUGACCUUCCUCCA | 1921 |
| AD-1223178.1 | A-2282735.1 | 2311 | gsusgguuGfaCfCfUfuccuccaucaL96 | A-2282736.1 | 2760 | VPusGfsaugGfaggaaggUfcAfaccacsusc | GAGUGGUUGACCUUCCUCCAUCC | 1922 |
| AD-1223179.1 | A-2282737.1 | 2312 | ususguggAfgGfCfAfgagaaaagaaL96 | A-2282738.1 | 2761 | VPusUfscuuUfucucugcCfuCfcacaasusg | CAUUGUGGAGGCAGAGAAAAGAG | 1923 |
| AD-1223180.1 | A-2282739.1 | 2313 | usgsuggaGfgCfAfGfagaaaagagaL96 | A-2282740.1 | 2762 | VPusCfsucuUfuucucugCfcUfccacasasu | AUUGUGGAGGCAGAGAAAAGAGA | 1924 |
| AD-1223181.1 | A-2282741.1 | 2314 | gsusggagGfcAfGfAfgaaaagagaaL96 | A-2282742.1 | 2763 | VPusUfscucUfuuucucuGfcCfuccacsasa | UUGUGGAGGCAGAGAAAAGAGAA | 1925 |
| AD-1223182.1 | A-2282743.1 | 2315 | usgsgaggCfaGfAfGfaaaagagaaaL96 | A-2282744.1 | 2764 | VPusUfsucuCfuuuucucUfgCfcuccascsa | UGUGGAGGCAGAGAAAAGAGAAA | 1926 |
| AD-1223183.1 | A-2282745.1 | 2316 | gsgsaggcAfgAfGfAfaaagagaaaaL96 | A-2282746.1 | 2765 | VPusUfsuucUfcuuuucuCfuGfccuccsasc | GUGGAGGCAGAGAAAAGAGAAAG | 1927 |
| AD-1223184.1 | A-2282747.1 | 2317 | gsasggcaGfaGfAfAfaagagaaagaL96 | A-2282748.1 | 2766 | VPusCfsuuuCfucuuuucUfcUfgccucscsa | UGGAGGCAGAGAAAAGAGAAAGU | 1928 |
| AD-1223185.1 | A-2282749.1 | 2318 | asgsgcagAfgAfAfAfagagaaaguaL96 | A-2282750.1 | 2767 | VPusAfscuuUfcucuuuuCfuCfugccuscsc | GGAGGCAGAGAAAAGAGAAAGUG | 1929 |

TABLE 8A-continued

| Exemplary Human VEGF-A siRNA Modified Single Strands and Duplex Sequences | | | | | | | | |
|---|---|---|---|---|---|---|---|---|
| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
| AD-1223186.1 | A-2282751.1 | 2319 | gsgscagaGfaAfAfAfgagaaagugaL96 | A-2282752.1 | 2768 | VPusCfsacuUfucucuuuUfcUfcugccsusc | GAGGCAGAGAAAAGAGAAAGUGU | 1930 |
| AD-1223187.1 | A-2282753.1 | 2320 | gscsagagAfaAfAfGfagaaaguguaL96 | A-2282754.1 | 2769 | VPusAfscacUfuucucuuUfuCfucugcscsu | AGGCAGAGAAAAGAGAAAGUGUU | 1931 |
| AD-1223188.1 | A-2282755.1 | 2321 | csasgagaAfaAfGfAfgaaaguguuaL96 | A-2282756.1 | 2770 | VPusAfsacaCfuuucucuUfuUfcucugscsc | GGCAGAGAAAAGAGAAAGUGUUU | 1932 |
| AD-1223189.1 | A-2282757.1 | 2322 | asgsagaaAfaGfAfGfaaaguguuuaL96 | A-2282758.1 | 2771 | VPusAfsaacAfcuuucucUfuUfucucusgsc | GCAGAGAAAAGAGAAAGUGUUUU | 1933 |
| AD-1223190.1 | A-2282759.1 | 2323 | gsasgaaaAfgAfGfAfaaguguuuuaL96 | A-2282760.1 | 2772 | VPusAfsaaaCfacuuucuCfuUfuucucsusg | CAGAGAAAAGAGAAAGUGUUUUA | 1934 |
| AD-1223191.1 | A-2282761.1 | 2324 | asgsaaaaGfaGfAfAfaguguuuuaaL96 | A-2282762.1 | 2773 | VPusUfsaaaAfcacuuucUfcUfuuucuscsu | AGAGAAAAGAGAAAGUGUUUUAU | 1935 |
| AD-1223192.1 | A-2282763.1 | 2325 | gsasaaagAfgAfAfAfguguuuuauaL96 | A-2282764.1 | 2774 | VPusAfsuaaAfacacuuuCfuCfuuuucsusc | GAGAAAAGAGAAAGUGUUUUAUA | 1936 |
| AD-1223193.1 | A-2282765.1 | 2326 | asasaagaGfaAfAfGfuguuuuauaaL96 | A-2282766.1 | 2775 | VPusUfsauaAfaacacuuUfcUfcuuuuscsu | AGAAAAGAGAAAGUGUUUUAUAU | 1937 |
| AD-1223194.1 | A-2282767.1 | 2327 | asasagagAfaAfGfUfguuuuauauaL96 | A-2282768.1 | 2776 | VPusAfsuauAfaaacacuUfuCfucuuususc | GAAAAGAGAAAGUGUUUUAUAUA | 1938 |
| AD-1223195.1 | A-2282769.1 | 2328 | asasgagaAfaGfUfGfuuuuauauaaL96 | A-2282770.1 | 2777 | VPusUfsauaUfaaaacacUfuUfcucuususu | AAAAGAGAAAGUGUUUUAUAUAC | 1939 |
| AD-1223196.1 | A-2282771.1 | 2329 | asgsagaaAfgUfGfUfuuuauauacaL96 | A-2282772.1 | 2778 | VPusGfsuauAfuaaaacaCfuUfucucususu | AAAGAGAAAGUGUUUUAUAUACG | 1940 |

TABLE 8A-continued

| Exemplary Human VEGF-A siRNA Modified Single Strands and Duplex Sequences | | | | | | | | |
|---|---|---|---|---|---|---|---|---|
| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
| AD-1223197.1 | A-2282773.1 | 2330 | gsasgaaaGfuGfUfUfuuauauacgaL96 | A-2282774.1 | 2779 | VPusCfsguaUfauaaaacAfcUfuucucsusu | AAGAGAAAGUGUUUUAUAUACGG | 1941 |
| AD-1223198.1 | A-2282775.1 | 2331 | asgsaaagUfgUfUfUfuauauacggaL96 | A-2282776.1 | 2780 | VPusCfscguAfuauaaaaCfaCfuuucuscsu | AGAGAAAGUGUUUUAUAUACGGU | 1942 |
| AD-1223199.1 | A-2282777.1 | 2332 | asasagugUfuUfUfAfuauacgguaaL96 | A-2282778.1 | 2781 | VPusUfsaccGfuauauaaAfaCfacuuuscsu | AGAAAGUGUUUUAUAUACGGUAC | 1943 |
| AD-1223200.1 | A-2282779.1 | 2333 | asasguguUfuUfAfUfauacgguacaL96 | A-2282780.1 | 2782 | VPusGfsuacCfguauauaAfaAfcacuususc | GAAAGUGUUUUAUAUACGGUACU | 1944 |
| AD-1223201.1 | A-2282781.1 | 2334 | asgsuguuUfuAfUfAfuacgguacuaL96 | A-2282782.1 | 2783 | VPusAfsguaCfcguauauAfaAfacacususu | AAAGUGUUUUAUAUACGGUACUU | 1945 |
| AD-1223202.1 | A-2282783.1 | 2335 | gsusguuuUfaUfAfUfacgguacuuaL96 | A-2282784.1 | 2784 | VPusAfsaguAfccguauaUfaAfaacacsusu | AAGUGUUUUAUAUACGGUACUUA | 1946 |
| AD-1223203.1 | A-2282785.1 | 2336 | usgsuuuuAfuAfUfAfcgguacuuaaL96 | A-2282786.1 | 2785 | VPusUfsaagUfaccguauAfuAfaaacascsu | AGUGUUUUAUAUACGGUACUUAU | 1947 |
| AD-1223204.1 | A-2282787.1 | 2337 | gsusuuuaUfaUfAfCfgguacuuauaL96 | A-2282788.1 | 2786 | VPusAfsuaaGfuaccguaUfaUfaaaacsasc | GUGUUUUAUAUACGGUACUUAUU | 1948 |
| AD-1223205.1 | A-2282789.1 | 2338 | ususuuauAfuAfCfGfguacuuauuaL96 | A-2282790.1 | 2787 | VPusAfsauaAfguaccguAfuAfuaaaascsa | UGUUUUAUAUACGGUACUUAUUU | 1949 |
| AD-1223206.1 | A-2282791.1 | 2339 | ususuauaUfaCfGfGfuacuuauuuaL96 | A-2282792.1 | 2788 | VPusAfsaauAfaguaccgUfaUfauaaaasasc | GUUUUAUAUACGGUACUUAUUUA | 1950 |
| AD-1223207.1 | A-2282793.1 | 2340 | ususauauAfcGfGfUfacuuauuuaaL96 | A-2282794.1 | 2789 | VPusUfsaaaUfaaguaccGfuAfuauaaasasa | UUUUAUAUACGGUACUUAUUUAA | 5040 |

TABLE 8A-continued

| Exemplary Human VEGF-A siRNA Modified Single Strands and Duplex Sequences | | | | | | | | |
|---|---|---|---|---|---|---|---|---|
| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
| AD-1223208.1 | A-2282795.1 | 2341 | usasuauaCfgGfUfAfcuuauuuaaaL96 | A-2282796.1 | 2790 | VPusUfsuaaAfuaaguacCfgUfauauasasa | UUUAUAUACGGUACUUAUUUAAU | 5041 |
| AD-1223209.1 | A-2282797.1 | 2342 | gsusacuuAfuUfUfAfauauccuuaL96 | A-2282798.1 | 2791 | VPusAfsaggGfauauuaaAfuAfaguacscsg | CGGUACUUAUUUAAUAUCCCUUU | 5042 |
| AD-1223210.1 | A-2282799.1 | 2343 | usascuuaUfuUfAfAfuaucccuuuaL96 | A-2282800.1 | 2792 | VPusAfsaagGfgauauuaAfaUfaaguascsc | GGUACUUAUUUAAUAUCCCUUUU | 5043 |
| AD-1223211.1 | A-2282801.1 | 2344 | ususaugaGfaUfGfUfaucuuuugcaL96 | A-2282802.1 | 2793 | VPusGfscaaAfagauacaUfcUfcauaasasu | AUUUAUGAGAUGUAUCUUUUGCU | 5044 |
| AD-1223212.1 | A-2282803.1 | 2345 | usasugagAfuGfUfAfucuuuugcuaL96 | A-2282804.1 | 2794 | VPusAfsgcaAfaagauacAfuCfucauasasa | UUUAUGAGAUGUAUCUUUUGCUC | 5045 |
| AD-1223213.1 | A-2282805.1 | 2346 | asusgagaUfgUfAfUfcuuuugcucaL96 | A-2282806.1 | 2795 | VPusGfsagcAfaaagauaCfaUfcucausasa | UUAUGAGAUGUAUCUUUUGCUCU | 5046 |
| AD-1223214.1 | A-2282807.1 | 2347 | usgsagauGfuAfUfCfuuuugcucuaL96 | A-2282808.1 | 2796 | VPusAfsgagCfaaaagauAfcAfucucasusa | UAUGAGAUGUAUCUUUUGCUCUC | 5047 |
| AD-1223215.1 | A-2282809.1 | 2348 | gsasgaugUfaUfCfUfuuugcucucaL96 | A-2282810.1 | 2797 | VPusGfsagaGfcaaaagaUfaCfaucucsasu | AUGAGAUGUAUCUUUUGCUCUCU | 5048 |
| AD-1223216.1 | A-2282811.1 | 2349 | asgsauguAfuCfUfUfuugcucucuaL96 | A-2282812.1 | 2798 | VPusAfsgagAfgcaaaagAfuAfcaucuscsa | UGAGAUGUAUCUUUUGCUCUCUC | 5049 |
| AD-1223217.1 | A-2282813.1 | 2350 | gsasuguaUfcUfUfUfugcucucucaL96 | A-2282814.1 | 2799 | VPusGfsagaGfagcaaaaGfaUfacaucsusc | GAGAUGUAUCUUUUGCUCUCUCU | 5050 |
| AD-1223218.1 | A-2282815.1 | 2351 | asusguauCfuUfUfUfgcucucucuaL96 | A-2282816.1 | 2800 | VPusAfsgagAfgagcaaaAfgAfuacauscsu | AGAUGUAUCUUUUGCUCUCUCUU | 5051 |

TABLE 8A-continued

| Exemplary Human VEGF-A siRNA Modified Single Strands and Duplex Sequences | | | | | | | | |
|---|---|---|---|---|---|---|---|---|
| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
| AD-1223219.1 | A-2282817.1 | 2352 | gscsucucUfcUfUfGfcucucuuauaL96 | A-2282818.1 | 2801 | VPusAfsuaaGfagagcaaGfaGfagagcsasa | UUGCUCUCUCUUGCUCUCUUAUU | 5052 |
| AD-1223220.1 | A-2282819.1 | 2353 | csuscucuCfuUfGfCfucucuuauuaL96 | A-2282820.1 | 2802 | VPusAfsauaAfgagagcaAfgAfgagagscsa | UGCUCUCUCUUGCUCUCUUAUUU | 5053 |
| AD-1223221.1 | A-2282821.1 | 2354 | uscsucucUfuGfCfUfcucuuauuuaL96 | A-2282822.1 | 2803 | VPusAfsaauAfagagagcAfaGfagagasgsc | GCUCUCUCUUGCUCUCUUAUUUG | 5054 |
| AD-1223222.1 | A-2282823.1 | 2355 | csuscucuUfgCfUfCfucuuauuugaL96 | A-2282824.1 | 2804 | VPusCfsaaaUfaagagagCfaAfgagagsasg | CUCUCUCUUGCUCUCUUAUUUGU | 5055 |
| AD-1223223.1 | A-2282825.1 | 2356 | uscsucuuGfcUfCfUfcuuauuuguaL96 | A-2282826.1 | 2805 | VPusAfscaaAfuaagagaGfcAfagagasgsa | UCUCUCUUGCUCUCUUAUUUGUA | 5056 |
| AD-1223224.1 | A-2282827.1 | 2357 | csuscuugCfuCfUfCfuuauuuguaaL96 | A-2282828.1 | 2806 | VPusUfsacaAfauaagagAfgCfaagagsasg | CUCUCUUGCUCUCUUAUUUGUAC | 5057 |
| AD-1223225.1 | A-2282829.1 | 2358 | uscsuugcUfcUfCfUfuauuuguacaL96 | A-2282830.1 | 2807 | VPusGfsuacAfaauaagaGfaGfcaagasgsa | UCUCUUGCUCUCUUAUUUGUACC | 5058 |
| AD-1223226.1 | A-2282831.1 | 2359 | csusugcuCfuCfUfUfauuuguaccaL96 | A-2282832.1 | 2808 | VPusGfsguaCfaaauaagAfgAfgcaagsasg | CUCUUGCUCUCUUAUUUGUACCG | 5059 |
| AD-1223227.1 | A-2282833.1 | 2360 | ususgcucUfcUfUfAfuuuguaccgaL96 | A-2282834.1 | 2809 | VPusCfsgguAfcaaauaaGfaGfagcaasgsa | UCUUGCUCUCUUAUUUGUACCGG | 5060 |
| AD-1223228.1 | A-2282835.1 | 2361 | usgscucuCfuUfAfUfuuguaccggaL96 | A-2282836.1 | 2810 | VPusCfscggUfacaaauaAfgAfgagcasasg | CUUGCUCUCUUAUUUGUACCGGU | 5061 |
| AD-1223229.1 | A-2282837.1 | 2362 | csuscucuUfaUfUfUfguaccgguuaL96 | A-2282838.1 | 2811 | VPusAfsaccGfguacaaaUfaAfgagagscsa | UGCUCUCUUAUUUGUACCGGUUU | 5062 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1223230.1 | A-2282839.1 | 2363 | uscsucuuAfuUfUfGfuaccgguuuaL96 | A-2282840.1 | 2812 | VPusAfsaacCfgguacaaAfuAfagagasgsc | GCUCUCUUAUUUGUACCGGUUUU | 5063 |
| AD-1223231.1 | A-2282841.1 | 2364 | csuscuuaUfuUfGfUfaccgguuuuaL96 | A-2282842.1 | 2813 | VPusAfsaaaCfcgguacaAfaUfaagagsasg | CUCUCUUAUUUGUACCGGUUUUU | 5064 |
| AD-1223232.1 | A-2282843.1 | 2365 | uscsuuauUfuGfUfAfccgguuuuuaL96 | A-2282844.1 | 2814 | VPusAfsaaaAfccgguacAfaAfuaagasgsa | UCUCUUAUUUGUACCGGUUUUUG | 5065 |
| AD-1223233.1 | A-2282845.1 | 2366 | csusuauuUfgUfAfCfcgguuuuugaL96 | A-2282846.1 | 2815 | VPusCfsaaaAfaccgguaCfaAfauaagsasg | CUCUUAUUUGUACCGGUUUUUGU | 5066 |
| AD-1223234.1 | A-2282847.1 | 2367 | ususauuuGfuAfCfCfgguuuuuguaL96 | A-2282848.1 | 2816 | VPusAfscaaAfaaccgguAfcAfaauaasgsa | UCUUAUUUGUACCGGUUUUUGUA | 5067 |
| AD-1223235.1 | A-2282849.1 | 2368 | usasuuugUfaCfCfGfguuuuuguaaL96 | A-2282850.1 | 2817 | VPusUfsacaAfaaaccggUfaCfaaauasasg | CUUAUUUGUACCGGUUUUUGUAU | 5068 |
| AD-1223236.1 | A-2282851.1 | 2369 | asusuuguAfcCfGfGfuuuuuguauaL96 | A-2282852.1 | 2818 | VPusAfsuacAfaaaaccgGfuAfcaaausasa | UUAUUUGUACCGGUUUUUGUAUA | 5069 |
| AD-1223237.1 | A-2282853.1 | 2370 | ususuguaCfcGfGfUfuuuuguauaaL96 | A-2282854.1 | 2819 | VPusUfsauaCfaaaaaccGfgUfacaaasusa | UAUUUGUACCGGUUUUUGUAUAU | 5070 |
| AD-1223238.1 | A-2282855.1 | 2371 | ususguacCfgGfUfUfuuuguauauaL96 | A-2282856.1 | 2820 | VPusAfsuauAfcaaaaacCfgGfuacaasasu | AUUUGUACCGGUUUUUGUAUAUA | 5071 |
| AD-1223239.1 | A-2282857.1 | 2372 | usgsuaccGfgUfUfUfuuguauauaaL96 | A-2282858.1 | 2821 | VPusUfsauaUfacaaaaaCfcGfguacasasa | UUUGUACCGGUUUUUGUAUAUAA | 5072 |
| AD-1223240.1 | A-2282859.1 | 2373 | gsusaccgGfuUfUfUfuguauauaaaL96 | A-2282860.1 | 2822 | VPusUfsuauAfuacaaaaAfcCfgguacsasa | UUGUACCGGUUUUUGUAUAUAAA | 5073 |

TABLE 8A-continued

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| Exemplary Human VEGF-A siRNA Modified Single Strands and Duplex Sequences | | | | | | | | |
| AD-1223241.1 | A-2282861.1 | 2374 | usasccggUfuUfUfUfguauauaaaaL96 | A-2282862.1 | 2823 | VPusUfsuuaUfauacaaaAfaCfcgguascsa | UGUACCGGUUUUUGUAUAUAAAA | 5074 |
| AD-1223242.1 | A-2282863.1 | 2375 | ascscgguUfuUfUfGfuauauaaaaL96 | A-2282864.1 | 2824 | VPusUfsuuuAfuauacaaAfaAfccggusasc | GUACCGGUUUUUGUAUAUAAAAU | 5075 |
| AD-1223243.1 | A-2282865.1 | 2376 | asusucauGfuUfUfCfcaaucucucaL96 | A-2282866.1 | 2825 | VPusGfsagaGfauuggaaAfcAfugaaususu | AAAUUCAUGUUUCCAAUCUCUCU | 5076 |
| AD-1223244.1 | A-2282867.1 | 2377 | ususcaugUfuUfCfCfaaucucucuaL96 | A-2282868.1 | 2826 | VPusAfsgagAfgauuggaAfaCfaugaasusu | AAUUCAUGUUUCCAAUCUCUCUC | 5077 |
| AD-1223245.1 | A-2282869.1 | 2378 | uscsauguUfuCfCfAfaucucucucaL96 | A-2282870.1 | 2827 | VPusGfsagaGfagauuggAfaAfcaugasasu | AUUCAUGUUUCCAAUCUCUCUCU | 5078 |
| AD-1223246.1 | A-2282871.1 | 2379 | csasuguuUfcCfAfAfucucucucuaL96 | A-2282872.1 | 2828 | VPusAfsgagAfgagauugGfaAfacaugsasa | UUCAUGUUUCCAAUCUCUCUCUC | 5079 |
| AD-1223247.1 | A-2282873.1 | 2380 | asusguuuCfcAfAfUfcucucucucaL96 | A-2282874.1 | 2829 | VPusGfsagaGfagagauuGfgAfaacausgsa | UCAUGUUUCCAAUCUCUCUCUCC | 5080 |
| AD-1223248.1 | A-2282875.1 | 2381 | usgsuuucCfaAfUfCfucucucuccaL96 | A-2282876.1 | 2830 | VPusGfsgagAfgagagauUfgGfaaacasusg | CAUGUUUCCAAUCUCUCUCUCCC | 5081 |
| AD-1223249.1 | A-2282877.1 | 2382 | ususuccaAfuCfUfCfucucucccuaL96 | A-2282878.1 | 2831 | VPusAfsgggAfgagagagAfuUfggaaascsa | UGUUUCCAAUCUCUCUCUCCCUG | 5082 |
| AD-1223250.1 | A-2282879.1 | 2383 | uscscaauCfuCfUfCfucucccugaaL96 | A-2282880.1 | 2832 | VPusUfscagGfgagagagAfgAfuuggasasa | UUUCCAAUCUCUCUCUCCCUGAU | 5083 |
| AD-1223251.1 | A-2282881.1 | 2384 | csgsgugaCfaGfUfCfacuagcuuaaL96 | A-2282882.1 | 2833 | VPusUfsaagCfuagugacUfgUfcaccgsasu | AUCGGUGACAGUCACUAGCUUAU | 5084 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1223252.1 | A-2282883.1 | 2385 | gsgsugacAfgUfCfAfcuagcuuauaL96 | A-2282884.1 | 2834 | VPusAfsuaaGfcuagugaCfuGfucaccsgsa | UCGGUGACAGUCACUAGCUUAUC | 5085 |
| AD-1223253.1 | A-2282885.1 | 2386 | asgsucacUfaGfCfUfuaucuugaaaL96 | A-2282886.1 | 2835 | VPusUfsucaAfgauaagcUfaGfugacusgsu | ACAGUCACUAGCUUAUCUUGAAC | 5086 |
| AD-1223254.1 | A-2282887.1 | 2387 | gsuscacuAfgCfUfUfaucuugaacaL96 | A-2282888.1 | 2836 | VPusGfsuucAfagauaagCfuAfgugacsusg | CAGUCACUAGCUUAUCUUGAACA | 5087 |
| AD-1223255.1 | A-2282889.1 | 2388 | uscsacuaGfcUfUfAfucuugaacaaL96 | A-2282890.1 | 2837 | VPusUfsguuCfaagauaaGfcUfagugascsu | AGUCACUAGCUUAUCUUGAACAG | 5088 |
| AD-1223256.1 | A-2282891.1 | 2389 | ascsuagcUfuAfUfCfuugaacagaaL96 | A-2282892.1 | 2838 | VPusUfscugUfucaagauAfaGfcuagusgsa | UCACUAGCUUAUCUUGAACAGAU | 5089 |
| AD-1223257.1 | A-2282893.1 | 2390 | csusagcuUfaUfCfUfugaacagauaL96 | A-2282894.1 | 2839 | VPusAfsucuGfuucaagaUfaAfgcuagsusg | CACUAGCUUAUCUUGAACAGAUA | 5090 |
| AD-1223258.1 | A-2282895.1 | 2391 | usasgcuuAfuCfUfUfgaacagauaaL96 | A-2282896.1 | 2840 | VPusUfsaucUfguucaagAfuAfagcuasgsu | ACUAGCUUAUCUUGAACAGAUAU | 5091 |
| AD-1223259.1 | A-2282897.1 | 2392 | asgscuuaUfcUfUfGfaacagauauaL96 | A-2282898.1 | 2841 | VPusAfsuauCfuguucaaGfaUfaagcusasg | CUAGCUUAUCUUGAACAGAUAUU | 5092 |
| AD-1223260.1 | A-2282899.1 | 2393 | gscsuuauCfuUfGfAfacagauauuaL96 | A-2282900.1 | 2842 | VPusAfsauaUfcuguucaAfgAfuaagcsusa | UAGCUUAUCUUGAACAGAUAUUU | 5093 |
| AD-1223261.1 | A-2282901.1 | 2394 | csasgcacAfcAfUfUfccuuugaaaaL96 | A-2282902.1 | 2843 | VPusUfsuucAfaaggaauGfuGfugcugsgsg | CCCAGCACACAUUCCUUUGAAAU | 5094 |
| AD-1223262.1 | A-2282903.1 | 2395 | asgscacaCfaUfUfCfcuuugaaauaL96 | A-2282904.1 | 2844 | VPusAfsuuuCfaaaggaaUfgUfgugcusgsg | CCAGCACACAUUCCUUUGAAAUA | 5095 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1223263.1 | A-2282905.1 | 2396 | gscsacacAfuUfCfCfuuugaaauaaL96 | A-2282906.1 | 2845 | VPusUfsauuUfcaaaggaAfuGfugugcsusg | CAGCACACAUUCCUUUGAAAUAA | 5096 |
| AD-1223264.1 | A-2282907.1 | 2397 | csascacaUfuCfCfUfuugaaauaaaL96 | A-2282908.1 | 2846 | VPusUfsuauUfucaaaggAfaUfgugugscsu | AGCACACAUUCCUUUGAAAUAAG | 5097 |
| AD-1223265.1 | A-2282909.1 | 2398 | csascauuCfcUfUfUfgaaauaaggaL96 | A-2282910.1 | 2847 | VPusCfscuuAfuuucaaaGfgAfaugugsusg | CACACAUUCCUUUGAAAUAAGGU | 5098 |
| AD-1223266.1 | A-2282911.1 | 2399 | uscscuuuGfaAfAfUfaagguuucaaL96 | A-2282912.1 | 2848 | VPusUfsgaaAfccuuauuUfcAfaaggasasu | AUUCCUUUGAAAUAAGGUUUCAA | 5099 |
| AD-1223267.1 | A-2282913.1 | 2400 | csusuugaAfaUfAfAfgguuucaauaL96 | A-2282914.1 | 2849 | VPusAfsuugAfaaccuuaUfuUfcaaagsgsa | UCCUUUGAAAUAAGGUUUCAAUA | 5100 |
| AD-1223268.1 | A-2282915.1 | 2401 | ususugaaAfuAfAfGfguuucaauaaL96 | A-2282916.1 | 2850 | VPusUfsauuGfaaaccuuAfuUfucaaasgsg | CCUUUGAAAUAAGGUUUCAAUAU | 5101 |
| AD-1223269.1 | A-2282917.1 | 2402 | asgsguuuCfaAfUfAfuacaucuacaL96 | A-2282918.1 | 2851 | VPusGfsuagAfuguauauUfgAfaaccsusa | UAAGGUUUCAAUAUACAUCUACA | 5102 |
| AD-1223270.1 | A-2282919.1 | 2403 | gsgsuuucAfaUfAfUfacaucuacaaL96 | A-2282920.1 | 2852 | VPusUfsguaGfauguauaUfuGfaaaccsusu | AAGGUUUCAAUAUACAUCUACAU | 5103 |
| AD-1223271.1 | A-2282921.1 | 2404 | gsusuucaAfuAfUfAfcaucuacauaL96 | A-2282922.1 | 2853 | VPusAfsuguAfgauguauAfuUfgaaacscsu | AGGUUUCAAUAUACAUCUACAUA | 5104 |
| AD-1223272.1 | A-2282923.1 | 2405 | ususucaaUfaUfAfCfaucuacauaaL96 | A-2282924.1 | 2854 | VPusUfsaugUfagauguaUfaUfugaaascsc | GGUUUCAAUAUACAUCUACAUAC | 5105 |
| AD-1223273.1 | A-2282925.1 | 2406 | ususcaauAfuAfCfAfucuacauacaL96 | A-2282926.1 | 2855 | VPusGfsuauGfuagauguAfuAfuugaasasc | GUUUCAAUAUACAUCUACAUACU | 5106 |

TABLE 8A-continued

| Exemplary Human VEGF-A siRNA Modified Single Strands and Duplex Sequences | | | | | | | | |
|---|---|---|---|---|---|---|---|---|
| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
| AD-1223274.1 | A-2282927.1 | 2407 | usasuuugGfcAfAfCfuuguauuugaL96 | A-2282928.1 | 2856 | VPusCfsaaaUfacaaguuGfcCfaaauasusa | UAUAUUUGGCAACUUGUAUUUGU | 5107 |
| AD-1223275.1 | A-2282929.1 | 2408 | ususuggcAfaCfUfUfguauuugugaL96 | A-2282930.1 | 2857 | VPusCfsacaAfauacaagUfuGfccaaasusa | UAUUUGGCAACUUGUAUUUGUGU | 5108 |
| AD-1223276.1 | A-2282931.1 | 2409 | usgsgcaaCfuUfGfUfauuugugugaL96 | A-2282932.1 | 2858 | VPusCfsacaCfaaauacaAfgUfugccasasa | UUUGGCAACUUGUAUUUGUGUGU | 5109 |
| AD-1223277.1 | A-2282933.1 | 2410 | gsgscaacUfuGfUfAfuuuguguguaL96 | A-2282934.1 | 2859 | VPusAfscacAfcaaauacAfaGfuugccsasa | UUGGCAACUUGUAUUUGUGUGUA | 5110 |
| AD-1223278.1 | A-2282935.1 | 2411 | gscsaacuUfgUfAfUfuuguguguaaL96 | A-2282936.1 | 2860 | VPusUfsacaCfacaaauaCfaAfguugcscsa | UGGCAACUUGUAUUUGUGUGUAU | 5111 |
| AD-1223279.1 | A-2282937.1 | 2412 | csasacuuGfuAfUfUfuguguguauaL96 | A-2282938.1 | 2861 | VPusAfsuacAfcacaaauAfcAfaguugscsc | GGCAACUUGUAUUUGUGUGUAUA | 5112 |
| AD-1223280.1 | A-2282939.1 | 2413 | asascuugUfaUfUfUfgugugu auaaL96 | A-2282940.1 | 2862 | VPusUfsauaCfacacaaaUfaCfaaguusgsc | GCAACUUGUAUUUGUGUGUAUAU | 5113 |
| AD-1223281.1 | A-2282941.1 | 2414 | ascsuuguAfuUfUfGfugugu auauaL96 | A-2282942.1 | 2863 | VPusAfsuauAfcacacaaAfuAfcaagusus g | CAACUUGUAUUUGUGUGUAUAUA | 5114 |
| AD-1223282.1 | A-2282943.1 | 2415 | ususcugaUfaAfAfAfuagacauugaL96 | A-2282944.1 | 2864 | VPusCfsaauGfucuauuuUfaUfcagaasusc | GAUUCUGAUAAAAUAGACAUUGC | 5115 |
| AD-1223283.1 | A-2282945.1 | 2416 | usgsauaaAfaUfAfGfacauugcuaaL96 | A-2282946.1 | 2865 | VPusUfsagcAfaugucuaUfuUfuaucasgsa | UCUGAUAAAAUAGACAUUGCUAU | 5116 |
| AD-1223284.1 | A-2282947.1 | 2417 | gsasuaaaAfuAfGfAfcauugcuauaL96 | A-2282948.1 | 2866 | VPusAfsuagCfaaugucuAfuUfuuaucsasg | CUGAUAAAAUAGACAUUGCUAUU | 5117 |

TABLE 8A-continued

| Exemplary Human VEGF-A siRNA Modified Single Strands and Duplex Sequences | | | | | | | | |
|---|---|---|---|---|---|---|---|---|
| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
| AD-1223285.1 | A-2282949.1 | 2418 | usasaaauAfgAfCfAfuugcuauucaL96 | A-2282950.1 | 2867 | VPusGfsaauAfgcaauguCfuAfuuuuasusc | GAUAAAAUAGACAUUGCUAUUCU | 5118 |
| AD-1223286.1 | A-2282951.1 | 2419 | usasgacaUfuGfCfUfauucuguuuaL96 | A-2282952.1 | 2868 | VPusAfsaacAfgaauagcAfaUfgucuasusu | AAUAGACAUUGCUAUUCUGUUUU | 5119 |
| AD-1223287.1 | A-2282953.1 | 2420 | asgsacauUfgCfUfAfuucuguuuuaL96 | A-2282954.1 | 2869 | VPusAfsaaaCfagaauagCfaAfugucusasu | AUAGACAUUGCUAUUCUGUUUUU | 5120 |
| AD-1223288.1 | A-2282955.1 | 2421 | uscsuacaUfaCfUfAfaaucucucuaL96 | A-2282956.1 | 2870 | VPusAfsgagAfgauuuagUfaUfguagasasu | AUUCUACAUACUAAAUCUCUCUC | 5121 |
| AD-1223289.1 | A-2282957.1 | 2422 | csusacauAfcUfAfAfaucucucucaL96 | A-2282958.1 | 2871 | VPusGfsagaGfagauuuaGfuAfuguagsasa | UUCUACAUACUAAAUCUCUCUCC | 5122 |
| AD-1223290.1 | A-2282959.1 | 2423 | usascauaCfuAfAfAfucucucuccaL96 | A-2282960.1 | 2872 | VPusGfsgagAfgagauuuAfgUfauguasgsa | UCUACAUACUAAAUcucucuccu | 5123 |
| AD-1223291.1 | A-2282961.1 | 2424 | ascsauacUfaAfAfUfcucucuccuaL96 | A-2282962.1 | 2873 | VPusAfsggaGfagagauuUfaGfuaugusasg | CUACAUACUAAAUCUCUCUCCUU | 5124 |
| AD-1223292.1 | A-2282963.1 | 2425 | csasuacuAfaAfUfCfucucuccuuaL96 | A-2282964.1 | 2874 | VPusAfsaggAfgagagauUfuAfguaugsusa | UACAUACUAAAUCUCUCUCCUUU | 5125 |
| AD-1223293.1 | A-2282965.1 | 2426 | asusacuaAfaUfCfUfcucuccuuuaL96 | A-2282966.1 | 2875 | VPusAfsaagGfagagagaUfuUfaguausgsu | ACAUACUAAAUCUCUCUCCUUUU | 5126 |
| AD-1223294.1 | A-2282967.1 | 2427 | usascuaaAfuCfUfCfucuccuuuuaL96 | A-2282968.1 | 2876 | VPusAfsaaaGfgagagagAfuUfuaguasusg | CAUACUAAAUCUCUCUCCUUUUU | 5127 |
| AD-1223295.1 | A-2282969.1 | 2428 | csasuuuaUfuUfAfUfuggugcuacaL96 | A-2282970.1 | 2877 | VPusGfsuagCfaccaauaAfaUfaaaugsasu | AUCAUUUAUUUAUUGGUGCUACU | 5128 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1223296.1 | A-2282971.1 | 2429 | asusuuauUfuAfUfUfggugcuacuaL96 | A-2282972.1 | 2878 | VPusAfsguaGfcaccaauAfaAfuaaausgsa | UCAUUUAUUUAUUGGUGCUACUG | 5129 |
| AD-1223297.1 | A-2282973.1 | 2430 | ususuauuUfaUfUfGfgugcuacugaL96 | A-2282974.1 | 2879 | VPusCfsaguAfgcaccaaUfaAfauaaasusg | CAUUUAUUUAUUGGUGCUACUGU | 5130 |
| AD-1223298.1 | A-2282975.1 | 2431 | ususauuuAfuUfGfGfugcuacuguaL96 | A-2282976.1 | 2880 | VPusAfscagUfagcaccaAfuAfaauaaasasu | AUUUAUUUAUUGGUGCUACUGUU | 5131 |
| AD-1223299.1 | A-2282977.1 | 2432 | usasuuuaUfuGfGfUfgcuacuguuaL96 | A-2282978.1 | 2881 | VPusAfsacaGfuagcaccAfaUfaaauasasa | UUUAUUUAUUGGUGCUACUGUUU | 5132 |
| AD-1223300.1 | A-2282979.1 | 2433 | asusuuauUfgGfUfGfcuacuguuuaL96 | A-2282980.1 | 2882 | VPusAfsaacAfguagcacCfaAfuaaausasa | UUAUUUAUUGGUGCUACUGUUUA | 5133 |
| AD-1223301.1 | A-2282981.1 | 2434 | ususauugGfuGfCfUfacuguuuauaL96 | A-2282982.1 | 2883 | VPusAfsuaaAfcaguagcAfcCfaauaaasasu | AUUUAUUGGUGCUACUGUUUAUC | 5134 |
| AD-1223302.1 | A-2282983.1 | 2435 | asusugguGfcUfAfCfuguuuauccaL96 | A-2282984.1 | 2884 | VPusGfsgauAfaacaguaGfcAfccaausasa | UUAUUGGUGCUACUGUUUAUCCG | 5135 |
| AD-1223303.1 | A-2282985.1 | 2436 | gsasaaagAfuAfUfUfaacaucacgaL96 | A-2282986.1 | 2885 | VPusCfsgugAfuguuaauAfuCfuuuucscsc | GGGAAAAGAUAUUAACAUCACGU | 5136 |
| AD-1223304.1 | A-2282987.1 | 2437 | asascaucAfcGfUfCfuuugucucuaL96 | A-2282988.1 | 2886 | VPusAfsgagAfcaaagacGfuGfauguusasa | UUAACAUCACGUCUUUGUCUCUA | 5137 |
| AD-1223305.1 | A-2282989.1 | 2438 | ascsaucaCfgUfCfUfuugucucuaaL96 | A-2282990.1 | 2887 | VPusUfsagaGfacaaagaCfgUfgaugususa | UAACAUCACGUCUUUGUCUCUAG | 5138 |
| AD-1223306.1 | A-2282991.1 | 2439 | gsuscuuuGfuCfUfCfuagugcaguaL96 | A-2282992.1 | 2888 | VPusAfscugCfacuagagAfcAfaagacsgsu | ACGUCUUUGUCUCUAGUGCAGUU | 5139 |

TABLE 8A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1223307.1 | A-2282993.1 | 2440 | uscsuuugUfcUfCfUfagugcaguuaL96 | A-2282994.1 | 2889 | VPusAfsacuGfcacuagaGfaCfaaagascsg | CGUCUUUGUCUCUAGUGCAGUUU | 5140 |
| AD-1223308.1 | A-2282995.1 | 2441 | csusuuguCfuCfUfAfgugcaguuuaL96 | A-2282996.1 | 2890 | VPusAfsaacUfgcacuagAfgAfcaaagsasc | GUCUUUGUCUCUAGUGCAGUUUU | 5141 |
| AD-1223309.1 | A-2282997.1 | 2442 | gsasgauaUfuCfCfGfuaguacauaaL96 | A-2282998.1 | 2891 | VPusUfsaugUfacuacggAfaUfaucucsgsa | UCGAGAUAUUCCGUAGUACAUAU | 5142 |
| AD-1223310.1 | A-2282999.1 | 2443 | asgsauauUfcCfGfUfaguacauauaL96 | A-2283000.1 | 2892 | VPusAfsuauGfuacuacgGfaAfuaucuscsg | CGAGAUAUUCCGUAGUACAUAUU | 5143 |
| AD-1223311.1 | A-2283001.1 | 2444 | gsasuauuCfcGfUfAfguacauauuaL96 | A-2283002.1 | 2893 | VPusAfsauaUfguacuacGfgAfauaucsusc | GAGAUAUUCCGUAGUACAUAUUU | 5144 |
| AD-1223312.1 | A-2283003.1 | 2445 | csgsacaaAfgAfAfAfuacagauauaL96 | A-2283004.1 | 2894 | VPusAfsuauCfuguauuuCfuUfugucgsusu | AACGACAAAGAAAUACAGAUAUA | 5145 |
| AD-1223313.1 | A-2283005.1 | 2446 | gsascaaaGfaAfAfUfacagauauaaL96 | A-2283006.1 | 2895 | VPusUfsauaUfcuguauuUfcUfuugucsgsu | ACGACAAAGAAAUACAGAUAUAU | 5146 |
| AD-1223314.1 | A-2283007.1 | 2447 | ascsaaagAfaAfUfAfcagauauauaL96 | A-2283008.1 | 2896 | VPusAfsuauAfucuguauUfuCfuuuguscsg | CGACAAAGAAAUACAGAUAUAUC | 5147 |
| AD-1223315.1 | A-2283009.1 | 2448 | csasaagaAfaUfAfCfagauauaucaL96 | A-2283010.1 | 2897 | VPusGfsauaUfaucuguaUfuUfcuuugsusc | GACAAAGAAAUACAGAUAUAUCU | 5148 |

TABLE 8B

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1222866.1 | A-2282111.1 | 2898 | CGGUGCUGGAAUUUGAUAUUA | 123-143 | A-2282112.1 | 3347 | UAAUAUCAAAUUCCAGCACCGAG | 121-143 |
| AD-1222867.1 | A-2282113.1 | 2899 | GGUGCUGGAAUUUGAUAUUCA | 124-144 | A-2282114.1 | 3348 | UGAAUAUCAAAUUCCAGCACCGA | 122-144 |
| AD-1222868.1 | A-2282115.1 | 2900 | UGCUGGAAUUUGAUAUUCAUA | 126-146 | A-2282116.1 | 3349 | UAUGAAUAUCAAAUUCCAGCACC | 124-146 |
| AD-1222869.1 | A-2282117.1 | 2901 | GCUGGAAUUUGAUAUUCAUUA | 127-147 | A-2282118.1 | 3350 | UAAUGAAUAUCAAAUUCCAGCAC | 125-147 |
| AD-1222870.1 | A-2282119.1 | 2902 | UGGAAUUUGAUAUUCAUUGAA | 129-149 | A-2282120.1 | 3351 | UUCAAUGAAUAUCAAAUUCCAGC | 127-149 |
| AD-1222871.1 | A-2282121.1 | 2903 | GGAAUUUGAUAUUCAUUGAUA | 130-150 | A-2282122.1 | 3352 | UAUCAAUGAAUAUCAAAUUCCAG | 128-150 |
| AD-1222872.1 | A-2282123.1 | 2904 | GAAUUUGAUAUUCAUUGAUCA | 131-151 | A-2282124.1 | 3353 | UGAUCAAUGAAUAUCAAAUUCCA | 129-151 |
| AD-1222873.1 | A-2282125.1 | 2905 | AAUUUGAUAUUCAUUGAUCCA | 132-152 | A-2282126.1 | 3354 | UGGAUCAAUGAAUAUCAAAUUCC | 130-152 |
| AD-1222874.1 | A-2282127.1 | 2906 | AUUUGAUAUUCAUUGAUCCGA | 133-153 | A-2282128.1 | 3355 | UCGGAUCAAUGAAUAUCAAAUUC | 131-153 |
| AD-1222875.1 | A-2282129.1 | 2907 | UUUGAUAUUCAUUGAUCCGGA | 134-154 | A-2282130.1 | 3356 | UCCGGAUCAAUGAAUAUCAAAUU | 132-154 |
| AD-1222876.1 | A-2282131.1 | 2908 | UUUAUUUUUGCUUGCCAUUCA | 217-237 | A-2282132.1 | 3357 | UGAAUGGCAAGCAAAAAUAAAUU | 215-237 |
| AD-1222877.1 | A-2282133.1 | 2909 | UUAUUUUUGCUUGCCAUUCCA | 218-238 | A-2282134.1 | 3358 | UGGAAUGGCAAGCAAAAAUAAAU | 216-238 |
| AD-1222878.1 | A-2282135.1 | 2910 | CAAAUCACUGUGGAUUUUGGA | 283-303 | A-2282136.1 | 3359 | UCCAAAAUCCACAGUGAUUUGGG | 281-303 |
| AD-1222879.1 | A-2282137.1 | 2911 | AAAUCACUGUGGAUUUUGGAA | 284-304 | A-2282138.1 | 3360 | UUCCAAAAUCCACAGUGAUUUGG | 282-304 |
| AD-1222880.1 | A-2282139.1 | 2912 | AAUCACUGUGGAUUUUGGAAA | 285-305 | A-2282140.1 | 3361 | UUUCCAAAAUCCACAGUGAUUUG | 283-305 |
| AD-1222881.1 | A-2282141.1 | 2913 | AUCACUGUGGAUUUUGGAAAA | 286-306 | A-2282142.1 | 3362 | UUUUCCAAAAUCCACAGUGAUUU | 284-306 |
| AD-1222882.1 | A-2282143.1 | 2914 | UCACUGUGGAUUUUGGAAACA | 287-307 | A-2282144.1 | 3363 | UGUUUCCAAAAUCCACAGUGAUU | 285-307 |
| AD-1222883.1 | A-2282145.1 | 2915 | CACUGUGGAUUUUGGAAACCA | 288-308 | A-2282146.1 | 3364 | UGGUUUCCAAAAUCCACAGUGAU | 286-308 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
|---|---|---|---|---|---|---|---|---|
| AD-1222884.1 | A-2282147.1 | 2916 | ACUGUGGAUUUUGGAAACCAA | 289-309 | A-2282148.1 | 3365 | UUGGUUUCCAAAAUCCACAGUGA | 287-309 |
| AD-1222885.1 | A-2282149.1 | 2917 | CUGUGGAUUUUGGAAACCAGA | 290-310 | A-2282150.1 | 3366 | UCUGGUUUCCAAAAUCCACAGUG | 288-310 |
| AD-1222886.1 | A-2282151.1 | 2918 | UGUGGAUUUUGGAAACCAGCA | 291-311 | A-2282152.1 | 3367 | UGCUGGUUUCCAAAAUCCACAGU | 289-311 |
| AD-1222887.1 | A-2282153.1 | 2919 | GUGGAUUUUGGAAACCAGCAA | 292-312 | A-2282154.1 | 3368 | UUGCUGGUUUCCAAAAUCCACAG | 290-312 |
| AD-1222888.1 | A-2282155.1 | 2920 | GAUUUUGGAAACCAGCAGAAA | 295-315 | A-2282156.1 | 3369 | UUUCUGCUGGUUUCCAAAAUCCA | 293-315 |
| AD-1222889.1 | A-2282157.1 | 2921 | AUUUUGGAAACCAGCAGAAAA | 296-316 | A-2282158.1 | 3370 | UUUUCUGCUGGUUUCCAAAAUCC | 294-316 |
| AD-1222890.1 | A-2282159.1 | 2922 | UUUUGGAAACCAGCAGAAAGA | 297-317 | A-2282160.1 | 3371 | UCUUUCUGCUGGUUUCCAAAAUC | 295-317 |
| AD-1222891.1 | A-2282161.1 | 2923 | UUUGGAAACCAGCAGAAAGAA | 298-318 | A-2282162.1 | 3372 | UUCUUUCUGCUGGUUUCCAAAAU | 296-318 |
| AD-1222892.1 | A-2282163.1 | 2924 | GGAAACCAGCAGAAAGAGGAA | 301-321 | A-2282164.1 | 3373 | UUCCUCUUUCUGCUGGUUUCCAA | 299-321 |
| AD-1222893.1 | A-2282165.1 | 2925 | AAACCAGCAGAAAGAGGAAAA | 303-323 | A-2282166.1 | 3374 | UUUUCCUCUUUCUGCUGGUUUCC | 301-323 |
| AD-1222894.1 | A-2282167.1 | 2926 | AACCAGCAGAAAGAGGAAAGA | 304-324 | A-2282168.1 | 3375 | UCUUUCCUCUUUCUGCUGGUUUC | 302-324 |
| AD-1222895.1 | A-2282169.1 | 2927 | ACCAGCAGAAAGAGGAAAGAA | 305-325 | A-2282170.1 | 3376 | UUCUUUCCUCUUUCUGCUGGUUU | 303-325 |
| AD-1222896.1 | A-2282171.1 | 2928 | CCAGCAGAAAGAGGAAAGAGA | 306-326 | A-2282172.1 | 3377 | UCUCUUUCCUCUUUCUGCUGGUU | 304-326 |
| AD-1222897.1 | A-2282173.1 | 2929 | CAGCAGAAAGAGGAAAGAGGA | 307-327 | A-2282174.1 | 3378 | uccucuuuccucuuucUGCUGGU | 305-327 |
| AD-1222898.1 | A-2282175.1 | 2930 | AGCAGAAAGAGGAAAGAGGUA | 308-328 | A-2282176.1 | 3379 | UACCUCUUUCCUCUUUCUGCUGG | 306-328 |
| AD-1222899.1 | A-2282177.1 | 2931 | GCAGAAAGAGGAAAGAGGUAA | 309-329 | A-2282178.1 | 3380 | UUACCUCUUUCCUCUUUCUGCUG | 307-329 |
| AD-1222900.1 | A-2282179.1 | 2932 | CAGAAAGAGGAAAGAGGUAGA | 310-330 | A-2282180.1 | 3381 | UCUACCUCUUUCCUCUUUCUGCU | 308-330 |
| AD-1222901.1 | A-2282181.1 | 2933 | AAAGAGGAAAGAGGUAGCAAA | 313-333 | A-2282182.1 | 3382 | UUUGCUACCUCUUUCCUCUUUCU | 311-333 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1222902.1 | A-2282183.1 | 2934 | AAGAGGAAAGAGGUAGCAAGA | 314-334 | A-2282184.1 | 3383 | UCUUGCUACCUCUUUccucuuuc | 312-334 |
| AD-1222903.1 | A-2282185.1 | 2935 | AGAGGAAAGAGGUAGCAAGAA | 315-335 | A-2282186.1 | 3384 | UUCUUGCUACCUCUUuccucuuu | 313-335 |
| AD-1222904.1 | A-2282187.1 | 2936 | GAGGAAAGAGGUAGCAAGAGA | 316-336 | A-2282188.1 | 3385 | UCUCUUGCUACCUCUuuccucuu | 314-336 |
| AD-1222905.1 | A-2282189.1 | 2937 | GGAAAGAGGUAGCAAGAGCUA | 318-338 | A-2282190.1 | 3386 | UAGCUCUUGCUACCUcuuuccuc | 316-338 |
| AD-1222906.1 | A-2282191.1 | 2938 | AGGUAGCAAGAGCUCCAGAGA | 324-344 | A-2282192.1 | 3387 | UCUCUGGAGCUCUUGCUACCUCU | 322-344 |
| AD-1222907.1 | A-2282193.1 | 2939 | UCCAGAGAGAAGUCGAGGAAA | 337-357 | A-2282194.1 | 3388 | UUUCCUCGACUUCUCUCUGGAGC | 335-357 |
| AD-1222908.1 | A-2282195.1 | 2940 | CCAGAGAGAAGUCGAGGAAGA | 338-358 | A-2282196.1 | 3389 | UCUUCCUCGACUUCUCUCUGGAG | 336-358 |
| AD-1222909.1 | A-2282197.1 | 2941 | CAGAGAGAAGUCGAGGAAGAA | 339-359 | A-2282198.1 | 3390 | UUCUUCCUCGACUUCUCUCUGGA | 337-359 |
| AD-1222910.1 | A-2282199.1 | 2942 | AGAGAAGUCGAGGAAGAGAGA | 342-362 | A-2282200.1 | 3391 | UCUCUCUUCCUCGACUUCUCUCU | 340-362 |
| AD-1222911.1 | A-2282201.1 | 2943 | GAGAAGUCGAGGAAGAGAGAA | 343-363 | A-2282202.1 | 3392 | UUCUCUCUUCCUCGACUUCUCUC | 341-363 |
| AD-1222912.1 | A-2282203.1 | 2944 | GAAGUCGAGGAAGAGAGAGAA | 345-365 | A-2282204.1 | 3393 | UUCUCUCUCUUCCUCGACUUCUC | 343-365 |
| AD-1222913.1 | A-2282205.1 | 2945 | AGUGAGUGACCUGCUUUUGGA | 417-437 | A-2282206.1 | 3394 | UCCAAAAGCAGGUCACUCACUUU | 415-437 |
| AD-1222914.1 | A-2282207.1 | 2946 | GGCGUCGCACUGAAACUUUUA | 643-663 | A-2282208.1 | 3395 | UAAAAGUUUCAGUGCGACGCCGC | 641-663 |
| AD-1222915.1 | A-2282209.1 | 2947 | GUCGCACUGAAACUUUUCGUA | 646-666 | A-2282210.1 | 3396 | UACGAAAAGUUUCAGUGCGACGC | 644-666 |
| AD-1222916.1 | A-2282211.1 | 2948 | UCGCACUGAAACUUUUCGUCA | 647-667 | A-2282212.1 | 3397 | UGACGAAAAGUUUCAGUGCGACG | 645-667 |
| AD-1222917.1 | A-2282213.1 | 2949 | CACUGAAACUUUUCGUCCAAA | 650-670 | A-2282214.1 | 3398 | UUUGGACGAAAAGUUUCAGUGCG | 648-670 |
| AD-1222918.1 | A-2282215.1 | 2950 | ACUGAAACUUUUCGUCCAACA | 651-671 | A-2282216.1 | 3399 | UGUUGGACGAAAAGUUUCAGUGC | 649-671 |
| AD-1222920.1 | A-2282219.1 | 2951 | UGAAACUUUUCGUCCAACUUA | 653-673 | A-2282220.1 | 3400 | UAAGUUGGACGAAAAGUUUCAGU | 651-673 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1222921.1 | A-2282221.1 | 2952 | AACUUUUCGUCCAACUUCUGA | 656-676 | A-2282222.1 | 3401 | UCAGAAGUUGGACGAAAAGUUUC | 654-676 |
| AD-1222922.1 | A-2282223.1 | 2953 | CUGGGCUGUUCUCGCUUCGGA | 673-693 | A-2282224.1 | 3402 | UCCGAAGCGAGAACAGCCCAGAA | 671-693 |
| AD-1222923.1 | A-2282225.1 | 2954 | UGGGCUGUUCUCGCUUCGGAA | 674-694 | A-2282226.1 | 3403 | UUCCGAAGCGAGAACAGCCCAGA | 672-694 |
| AD-1222924.1 | A-2282227.1 | 2955 | GGGCUGUUCUCGCUUCGGAGA | 675-695 | A-2282228.1 | 3404 | UCUCCGAAGCGAGAACAGCCCAG | 673-695 |
| AD-1222925.1 | A-2282229.1 | 2956 | GCUGUUCUCGCUUCGGAGGAA | 677-697 | A-2282230.1 | 3405 | UUCCUCCGAAGCGAGAACAGCCC | 675-697 |
| AD-1222926.1 | A-2282231.1 | 2957 | GCCGCGAGAAGUGCUAGCUCA | 733-753 | A-2282232.1 | 3406 | UGAGCUAGCACUUCUCGCGGCUC | 731-753 |
| AD-1222927.1 | A-2282233.1 | 2958 | CCGCGAGAAGUGCUAGCUCGA | 734-754 | A-2282234.1 | 3407 | UCGAGCUAGCACUUCUCGCGGCU | 732-754 |
| AD-1222928.1 | A-2282235.1 | 2959 | GCCUCCGAAACCAUGAACUUA | 1027-1047 | A-2282236.1 | 3408 | UAAGUUCAUGGUUUCGGAGGCCC | 1025-1047 |
| AD-1222929.1 | A-2282237.1 | 2960 | AAGGAGGAGGGCAGAAUCAUA | 1130-1150 | A-2282238.1 | 3409 | UAUGAUUCUGCCCUCCUCCUUCU | 1128-1150 |
| AD-1222930.1 | A-2282239.1 | 2961 | GGCAGAAUCAUCACGAAGUGA | 1139-1159 | A-2282240.1 | 3410 | UCACUUCGUGAUGAUUCUGCCCU | 1137-1159 |
| AD-1222931.1 | A-2282241.1 | 2962 | AAUCAUCACGAAGUGGUGAAA | 1144-1164 | A-2282242.1 | 3411 | UUUCACCACUUCGUGAUGAUUCU | 1142-1164 |
| AD-1222932.1 | A-2282243.1 | 2963 | AUCAUCACGAAGUGGUGAAGA | 1145-1165 | A-2282244.1 | 3412 | UCUUCACCACUUCGUGAUGAUUC | 1143-1165 |
| AD-1222933.1 | A-2282245.1 | 2964 | UCAUCACGAAGUGGUGAAGUA | 1146-1166 | A-2282246.1 | 3413 | UACUUCACCACUUCGUGAUGAUU | 1144-1166 |
| AD-1222934.1 | A-2282247.1 | 2965 | CAUCACGAAGUGGUGAAGUUA | 1147-1167 | A-2282248.1 | 3414 | UAACUUCACCACUUCGUGAUGAU | 1145-1167 |
| AD-1222935.1 | A-2282249.1 | 2966 | UCACGAAGUGGUGAAGUUCAA | 1149-1169 | A-2282250.1 | 3415 | UUGAACUUCACCACUUCGUGAUG | 1147-1169 |
| AD-1222936.1 | A-2282251.1 | 2967 | AAGUGGUGAAGUUCAUGGAUA | 1154-1174 | A-2282252.1 | 3416 | UAUCCAUGAACUUCACCACUUCG | 1152-1174 |
| AD-1222937.1 | A-2282253.1 | 2968 | AGUGGUGAAGUUCAUGGAUGA | 1155-1175 | A-2282254.1 | 3417 | UCAUCCAUGAACUUCACCACUUC | 1153-1175 |
| AD-1222938.1 | A-2282255.1 | 2969 | GUGGUGAAGUUCAUGGAUGUA | 1156-1176 | A-2282256.1 | 3418 | UACAUCCAUGAACUUCACCACUU | 1154-1176 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1222939.1 | A-2282257.1 | 2970 | GGUGAAGUUCAUGGAUGUCUA | 1158-1178 | A-2282258.1 | 3419 | UAGACAUCCAUGAACUUCACCAC | 1156-1178 |
| AD-1222940.1 | A-2282259.1 | 2971 | GUGAAGUUCAUGGAUGUCUAA | 1159-1179 | A-2282260.1 | 3420 | UUAGACAUCCAUGAACUUCACCA | 1157-1179 |
| AD-1222941.1 | A-2282261.1 | 2972 | UGAAGUUCAUGGAUGUCUAUA | 1160-1180 | A-2282262.1 | 3421 | UAUAGACAUCCAUGAACUUCACC | 1158-1180 |
| AD-1222942.1 | A-2282263.1 | 2973 | AAGUUCAUGGAUGUCUAUCAA | 1162-1182 | A-2282264.1 | 3422 | UUGAUAGACAUCCAUGAACUUCA | 1160-1182 |
| AD-1222943.1 | A-2282265.1 | 2974 | AGUUCAUGGAUGUCUAUCAGA | 1163-1183 | A-2282266.1 | 3423 | UCUGAUAGACAUCCAUGAACUUC | 1161-1183 |
| AD-1222944.1 | A-2282267.1 | 2975 | UUCAUGGAUGUCUAUCAGCGA | 1165-1185 | A-2282268.1 | 3424 | UCGCUGAUAGACAUCCAUGAACU | 1163-1185 |
| AD-1222945.1 | A-2282269.1 | 2976 | GUGGACAUCUUCCAGGAGUAA | 1213-1233 | A-2282270.1 | 3425 | UUACUCCUGGAAGAUGUCCACCA | 1211-1233 |
| AD-1222946.1 | A-2282271.1 | 2977 | UCGAGUACAUCUUCAAGCCAA | 1244-1264 | A-2282272.1 | 3426 | UUGGCUUGAAGAUGUACUCGAUC | 1242-1264 |
| AD-1222947.1 | A-2282273.1 | 2978 | CGAGUACAUCUUCAAGCCAUA | 1245-1265 | A-2282274.1 | 3427 | UAUGGCUUGAAGAUGUACUCGAU | 1243-1265 |
| AD-1222948.1 | A-2282275.1 | 2979 | GAGUACAUCUUCAAGCCAUCA | 1246-1266 | A-2282276.1 | 3428 | UGAUGGCUUGAAGAUGUACUCGA | 1244-1266 |
| AD-1222949.1 | A-2282277.1 | 2980 | GUACAUCUUCAAGCCAUCCUA | 1248-1268 | A-2282278.1 | 3429 | UAGGAUGGCUUGAAGAUGUACUC | 1246-1268 |
| AD-1222950.1 | A-2282279.1 | 2981 | CCAACAUCACCAUGCAGAUUA | 1337-1357 | A-2282280.1 | 3430 | UAAUCUGCAUGGUGAUGUUGGAC | 1335-1357 |
| AD-1222951.1 | A-2282281.1 | 2982 | CAACAUCACCAUGCAGAUUAA | 1338-1358 | A-2282282.1 | 3431 | UUAAUCUGCAUGGUGAUGUUGGA | 1336-1358 |
| AD-1222952.1 | A-2282283.1 | 2983 | ACAUCACCAUGCAGAUUAUGA | 1340-1360 | A-2282284.1 | 3432 | UCAUAAUCUGCAUGGUGAUGUUG | 1338-1360 |
| AD-1222953.1 | A-2282285.1 | 2984 | CAUCACCAUGCAGAUUAUGCA | 1341-1361 | A-2282286.1 | 3433 | UGCAUAAUCUGCAUGGUGAUGUU | 1339-1361 |
| AD-1222954.1 | A-2282287.1 | 2985 | ACCAUGCAGAUUAUGCGGAUA | 1345-1365 | A-2282288.1 | 3434 | UAUCCGCAUAAUCUGCAUGGUGA | 1343-1365 |
| AD-1222955.1 | A-2282289.1 | 2986 | AUGCAGAUUAUGCGGAUCAAA | 1348-1368 | A-2282290.1 | 3435 | UUUGAUCCGCAUAAUCUGCAUGG | 1346-1368 |
| AD-1222956.1 | A-2282291.1 | 2987 | UGCAGAUUAUGCGGAUCAAAA | 1349-1369 | A-2282292.1 | 3436 | UUUUGAUCCGCAUAAUCUGCAUG | 1347-1369 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1222957.1 | A-2282293.1 | 2988 | GCAGAUUAUGCGGAUCAAACA | 1350-1370 | A-2282294.1 | 3437 | UGUUUGAUCCGCAUAAUCUGCAU | 1348-1370 |
| AD-1222958.1 | A-2282295.1 | 2989 | GAUUAUGCGGAUCAAACCUCA | 1353-1373 | A-2282296.1 | 3438 | UGAGGUUUGAUCCGCAUAAUCUG | 1351-1373 |
| AD-1222959.1 | A-2282297.1 | 2990 | AUUAUGCGGAUCAAACCUCAA | 1354-1374 | A-2282298.1 | 3439 | UUGAGGUUUGAUCCGCAUAAUCU | 1352-1374 |
| AD-1222960.1 | A-2282299.1 | 2991 | CGGAUCAAACCUCACCAAGGA | 1360-1380 | A-2282300.1 | 3440 | UCCUUGGUGAGGUUUGAUCCGCA | 1358-1380 |
| AD-1222961.1 | A-2282301.1 | 2992 | GGAGAGAUGAGCUUCCUACAA | 1390-1410 | A-2282302.1 | 3441 | UUGUAGGAAGCUCAUCUCUCCUA | 1388-1410 |
| AD-1222962.1 | A-2282303.1 | 2993 | GAGAUGAGCUUCCUACAGCAA | 1393-1413 | A-2282304.1 | 3442 | UUGCUGUAGGAAGCUCAUCUCUC | 1391-1413 |
| AD-1222963.1 | A-2282305.1 | 2994 | GAUGAGCUUCCUACAGCACAA | 1395-1415 | A-2282306.1 | 3443 | UUGUGCUGUAGGAAGCUCAUCUC | 1393-1415 |
| AD-1222964.1 | A-2282307.1 | 2995 | AUGAGCUUCCUACAGCACAAA | 1396-1416 | A-2282308.1 | 3444 | UUUGUGCUGUAGGAAGCUCAUCU | 1394-1416 |
| AD-1222965.1 | A-2282309.1 | 2996 | GAGCUUCCUACAGCACAACAA | 1398-1418 | A-2282310.1 | 3445 | UUGUUGUGCUGUAGGAAGCUCAU | 1396-1418 |
| AD-1222966.1 | A-2282311.1 | 2997 | AGCUUCCUACAGCACAACAAA | 1399-1419 | A-2282312.1 | 3446 | UUUGUUGUGCUGUAGGAAGCUCA | 1397-1419 |
| AD-1222967.1 | A-2282313.1 | 2998 | GCUUCCUACAGCACAACAAAA | 1400-1420 | A-2282314.1 | 3447 | UUUUGUUGUGCUGUAGGAAGCUC | 1398-1420 |
| AD-1222968.1 | A-2282315.1 | 2999 | CUUCCUACAGCACAACAAAUA | 1401-1421 | A-2282316.1 | 3448 | UAUUUGUUGUGCUGUAGGAAGCU | 1399-1421 |
| AD-1222969.1 | A-2282317.1 | 3000 | UCCUACAGCACAACAAAUGUA | 1403-1423 | A-2282318.1 | 3449 | UACAUUUGUUGUGCUGUAGGAAG | 1401-1423 |
| AD-1222970.1 | A-2282319.1 | 3001 | CUACAGCACAACAAAUGUGAA | 1405-1425 | A-2282320.1 | 3450 | UUCACAUUUGUUGUGCUGUAGGA | 1403-1425 |
| AD-1222971.1 | A-2282321.1 | 3002 | UACAGCACAACAAAUGUGAAA | 1406-1426 | A-2282322.1 | 3451 | UUUCACAUUUGUUGUGCUGUAGG | 1404-1426 |
| AD-1222972.1 | A-2282323.1 | 3003 | AGCACAACAAAUGUGAAUGCA | 1409-1429 | A-2282324.1 | 3452 | UGCAUUCACAUUUGUUGUGCUGU | 1407-1429 |
| AD-1222973.1 | A-2282325.1 | 3004 | GCACAACAAAUGUGAAUGCAA | 1410-1430 | A-2282326.1 | 3453 | UUGCAUUCACAUUUGUUGUGCUG | 1408-1430 |
| AD-1222974.1 | A-2282327.1 | 3005 | CUCACCAGGAAAGACUGAUAA | 1786-1806 | A-2282328.1 | 3454 | UUAUCAGUCUUUCCUGGUGAGAG | 1784-1806 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1222975.1 | A-2282329.1 | 3006 | UCACCAGGAAAGACUGAUACA | 1787-1807 | A-2282330.1 | 3455 | UGUAUCAGUCUUUCCUGGUGAGA | 1785-1807 |
| AD-1222976.1 | A-2282331.1 | 3007 | CACCAGGAAAGACUGAUACAA | 1788-1808 | A-2282332.1 | 3456 | UUGUAUCAGUCUUUCCUGGUGAG | 1786-1808 |
| AD-1222977.1 | A-2282333.1 | 3008 | ACCAGGAAAGACUGAUACAGA | 1789-1809 | A-2282334.1 | 3457 | UCUGUAUCAGUCUUUCCUGGUGA | 1787-1809 |
| AD-1222978.1 | A-2282335.1 | 3009 | CCAGGAAAGACUGAUACAGAA | 1790-1810 | A-2282336.1 | 3458 | UUCUGUAUCAGUCUUUCCUGGUG | 1788-1810 |
| AD-1222979.1 | A-2282337.1 | 3010 | CAGGAAAGACUGAUACAGAAA | 1791-1811 | A-2282338.1 | 3459 | UUUCUGUAUCAGUCUUUCCUGGU | 1789-1811 |
| AD-1222980.1 | A-2282339.1 | 3011 | AGGAAAGACUGAUACAGAACA | 1792-1812 | A-2282340.1 | 3460 | UGUUCUGUAUCAGUCUUUCCUGG | 1790-1812 |
| AD-1222981.1 | A-2282341.1 | 3012 | GGAAAGACUGAUACAGAACGA | 1793-1813 | A-2282342.1 | 3461 | UCGUUCUGUAUCAGUCUUUCCUG | 1791-1813 |
| AD-1222982.1 | A-2282343.1 | 3013 | GAAAGACUGAUACAGAACGAA | 1794-1814 | A-2282344.1 | 3462 | UUCGUUCUGUAUCAGUCUUUCCU | 1792-1814 |
| AD-1222983.1 | A-2282345.1 | 3014 | AAAGACUGAUACAGAACGAUA | 1795-1815 | A-2282346.1 | 3463 | UAUCGUUCUGUAUCAGUCUUUCC | 1793-1815 |
| AD-1222984.1 | A-2282347.1 | 3015 | AAGACUGAUACAGAACGAUCA | 1796-1816 | A-2282348.1 | 3464 | UGAUCGUUCUGUAUCAGUCUUUC | 1794-1816 |
| AD-1222985.1 | A-2282349.1 | 3016 | AGACUGAUACAGAACGAUCGA | 1797-1817 | A-2282350.1 | 3465 | UCGAUCGUUCUGUAUCAGUCUUU | 1795-1817 |
| AD-1222986.1 | A-2282351.1 | 3017 | GACUGAUACAGAACGAUCGAA | 1798-1818 | A-2282352.1 | 3466 | UUCGAUCGUUCUGUAUCAGUCUU | 1796-1818 |
| AD-1222987.1 | A-2282353.1 | 3018 | ACUGAUACAGAACGAUCGAUA | 1799-1819 | A-2282354.1 | 3467 | UAUCGAUCGUUCUGUAUCAGUCU | 1797-1819 |
| AD-1222988.1 | A-2282355.1 | 3019 | CUGAUACAGAACGAUCGAUAA | 1800-1820 | A-2282356.1 | 3468 | UUAUCGAUCGUUCUGUAUCAGUC | 1798-1820 |
| AD-1222989.1 | A-2282357.1 | 3020 | UGAUACAGAACGAUCGAUACA | 1801-1821 | A-2282358.1 | 3469 | UGUAUCGAUCGUUCUGUAUCAGU | 1799-1821 |
| AD-1222990.1 | A-2282359.1 | 3021 | GAUACAGAACGAUCGAUACAA | 1802-1822 | A-2282360.1 | 3470 | UUGUAUCGAUCGUUCUGUAUCAG | 1800-1822 |
| AD-1222991.1 | A-2282361.1 | 3022 | AUACAGAACGAUCGAUACAGA | 1803-1823 | A-2282362.1 | 3471 | UCUGUAUCGAUCGUUCUGUAUCA | 1801-1823 |
| AD-1222992.1 | A-2282363.1 | 3023 | UACAGAACGAUCGAUACAGAA | 1804-1824 | A-2282364.1 | 3472 | UUCUGUAUCGAUCGUUCUGUAUC | 1802-1824 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1222993.1 | A-2282365.1 | 3024 | ACAGAACGAUCGAUACAGAAA | 1805-1825 | A-2282366.1 | 3473 | UUUCUGUAUCGAUCGUUCUGUAU | 1803-1825 |
| AD-1222994.1 | A-2282367.1 | 3025 | CAGAACGAUCGAUACAGAAAA | 1806-1826 | A-2282368.1 | 3474 | UUUUCUGUAUCGAUCGUUCUGUA | 1804-1826 |
| AD-1222995.1 | A-2282369.1 | 3026 | AGAACGAUCGAUACAGAAACA | 1807-1827 | A-2282370.1 | 3475 | UGUUUCUGUAUCGAUCGUUCUGU | 1805-1827 |
| AD-1222996.1 | A-2282371.1 | 3027 | GAACGAUCGAUACAGAAACCA | 1808-1828 | A-2282372.1 | 3476 | UGGUUUCUGUAUCGAUCGUUCUG | 1806-1828 |
| AD-1222997.1 | A-2282373.1 | 3028 | AACGAUCGAUACAGAAACCAA | 1809-1829 | A-2282374.1 | 3477 | UUGGUUUCUGUAUCGAUCGUUCU | 1807-1829 |
| AD-1222998.1 | A-2282375.1 | 3029 | ACGAUCGAUACAGAAACCACA | 1810-1830 | A-2282376.1 | 3478 | UGUGGUUUCUGUAUCGAUCGUUC | 1808-1830 |
| AD-1222999.1 | A-2282377.1 | 3030 | CGAUCGAUACAGAAACCACGA | 1811-1831 | A-2282378.1 | 3479 | UCGUGGUUUCUGUAUCGAUCGUU | 1809-1831 |
| AD-1223000.1 | A-2282379.1 | 3031 | CACCAUCACCAUCGACAGAAA | 1843-1863 | A-2282380.1 | 3480 | UUUCUGUCGAUGGUGAUGGUGUG | 1841-1863 |
| AD-1223001.1 | A-2282381.1 | 3032 | CAUCACCAUCGACAGAACAGA | 1846-1866 | A-2282382.1 | 3481 | UCUGUUCUGUCGAUGGUGAUGGU | 1844-1866 |
| AD-1223002.1 | A-2282383.1 | 3033 | UCACCAUCGACAGAACAGUCA | 1848-1868 | A-2282384.1 | 3482 | UGACUGUUCUGUCGAUGGUGAUG | 1846-1868 |
| AD-1223003.1 | A-2282385.1 | 3034 | CACCAUCGACAGAACAGUCCA | 1849-1869 | A-2282386.1 | 3483 | UGGACUGUUCUGUCGAUGGUGAU | 1847-1869 |
| AD-1223004.1 | A-2282387.1 | 3035 | ACCAUCGACAGAACAGUCCUA | 1850-1870 | A-2282388.1 | 3484 | UAGGACUGUUCUGUCGAUGGUGA | 1848-1870 |
| AD-1223005.1 | A-2282389.1 | 3036 | CCAUCGACAGAACAGUCCUUA | 1851-1871 | A-2282390.1 | 3485 | UAAGGACUGUUCUGUCGAUGGUG | 1849-1871 |
| AD-1223006.1 | A-2282391.1 | 3037 | CAUCGACAGAACAGUCCUUAA | 1852-1872 | A-2282392.1 | 3486 | UUAAGGACUGUUCUGUCGAUGGU | 1850-1872 |
| AD-1223007.1 | A-2282393.1 | 3038 | AUCGACAGAACAGUCCUUAAA | 1853-1873 | A-2282394.1 | 3487 | UUUAAGGACUGUUCUGUCGAUGG | 1851-1873 |
| AD-1223008.1 | A-2282395.1 | 3039 | UCGACAGAACAGUCCUUAAUA | 1854-1874 | A-2282396.1 | 3488 | UAUUAAGGACUGUUCUGUCGAUG | 1852-1874 |
| AD-1223009.1 | A-2282397.1 | 3040 | CGACAGAACAGUCCUUAAUCA | 1855-1875 | A-2282398.1 | 3489 | UGAUUAAGGACUGUUCUGUCGAU | 1853-1875 |
| AD-1223010.1 | A-2282399.1 | 3041 | GACAGAACAGUCCUUAAUCCA | 1856-1876 | A-2282400.1 | 3490 | UGGAUUAAGGACUGUUCUGUCGA | 1854-1876 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1223011.1 | A-2282401.1 | 3042 | ACAGAACAGUCCUUAAUCCAA | 1857-1877 | A-2282402.1 | 3491 | UUGGAUUAAGGACUGUUCUGUCG | 1855-1877 |
| AD-1223012.1 | A-2282403.1 | 3043 | AGAACAGUCCUUAAUCCAGAA | 1859-1879 | A-2282404.1 | 3492 | UUCUGGAUUAAGGACUGUUCUGU | 1857-1879 |
| AD-1223013.1 | A-2282405.1 | 3044 | GAACAGUCCUUAAUCCAGAAA | 1860-1880 | A-2282406.1 | 3493 | UUUCUGGAUUAAGGACUGUUCUG | 1858-1880 |
| AD-1223014.1 | A-2282407.1 | 3045 | AACAGUCCUUAAUCCAGAAAA | 1861-1881 | A-2282408.1 | 3494 | UUUUCUGGAUUAAGGACUGUUCU | 1859-1881 |
| AD-1223015.1 | A-2282409.1 | 3046 | ACAGUCCUUAAUCCAGAAACA | 1862-1882 | A-2282410.1 | 3495 | UGUUUCUGGAUUAAGGACUGUUC | 1860-1882 |
| AD-1223016.1 | A-2282411.1 | 3047 | CAGUCCUUAAUCCAGAAACCA | 1863-1883 | A-2282412.1 | 3496 | UGGUUUCUGGAUUAAGGACUGUU | 1861-1883 |
| AD-1223017.1 | A-2282413.1 | 3048 | AGUCCUUAAUCCAGAAACCUA | 1864-1884 | A-2282414.1 | 3497 | UAGGUUUCUGGAUUAAGGACUGU | 1862-1884 |
| AD-1223018.1 | A-2282415.1 | 3049 | GUCCUUAAUCCAGAAACCUGA | 1865-1885 | A-2282416.1 | 3498 | UCAGGUUUCUGGAUUAAGGACUG | 1863-1885 |
| AD-1223019.1 | A-2282417.1 | 3050 | UCCUUAAUCCAGAAACCUGAA | 1866-1886 | A-2282418.1 | 3499 | UUCAGGUUUCUGGAUUAAGGACU | 1864-1886 |
| AD-1223020.1 | A-2282419.1 | 3051 | CCUUAAUCCAGAAACCUGAAA | 1867-1887 | A-2282420.1 | 3500 | UUUCAGGUUUCUGGAUUAAGGAC | 1865-1887 |
| AD-1223021.1 | A-2282421.1 | 3052 | CUUAAUCCAGAAACCUGAAAA | 1868-1888 | A-2282422.1 | 3501 | UUUUCAGGUUUCUGGAUUAAGGA | 1866-1888 |
| AD-1223022.1 | A-2282423.1 | 3053 | UUAAUCCAGAAACCUGAAAUA | 1869-1889 | A-2282424.1 | 3502 | UAUUUCAGGUUUCUGGAUUAAGG | 1867-1889 |
| AD-1223023.1 | A-2282425.1 | 3054 | CAGAAACCUGAAAUGAAGGAA | 1875-1895 | A-2282426.1 | 3503 | UUCCUUCAUUUCAGGUUUCUGGA | 1873-1895 |
| AD-1223024.1 | A-2282427.1 | 3055 | AGAAACCUGAAAUGAAGGAAA | 1876-1896 | A-2282428.1 | 3504 | UUUCCUUCAUUUCAGGUUUCUGG | 1874-1896 |
| AD-1223025.1 | A-2282429.1 | 3056 | GAAACCUGAAAUGAAGGAAGA | 1877-1897 | A-2282430.1 | 3505 | UCUUCCUUCAUUUCAGGUUUCUG | 1875-1897 |
| AD-1223026.1 | A-2282431.1 | 3057 | AAACCUGAAAUGAAGGAAGAA | 1878-1898 | A-2282432.1 | 3506 | UUCUUCCUUCAUUUCAGGUUUCU | 1876-1898 |
| AD-1223027.1 | A-2282433.1 | 3058 | AACCUGAAAUGAAGGAAGAGA | 1879-1899 | A-2282434.1 | 3507 | UCUCUUCCUUCAUUUCAGGUUUC | 1877-1899 |
| AD-1223028.1 | A-2282435.1 | 3059 | CCUGAAAUGAAGGAAGAGGAA | 1881-1901 | A-2282436.1 | 3508 | UUCCUCUUCCUUCAUUUCAGGUU | 1879-1901 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1223029.1 | A-2282437.1 | 3060 | AUGAAGGAAGAGGAGACUCUA | 1887-1907 | A-2282438.1 | 3509 | UAGAGUCUCCUCUUCCUUCAUUU | 1885-1907 |
| AD-1223030.1 | A-2282439.1 | 3061 | UCCCUCUUGGAAUUGGAUUCA | 1977-1997 | A-2282440.1 | 3510 | UGAAUCCAAUUCCAAGAGGGACC | 1975-1997 |
| AD-1223031.1 | A-2282441.1 | 3062 | CCUCUUGGAAUUGGAUUCGCA | 1979-1999 | A-2282442.1 | 3511 | UGCGAAUCCAAUUCCAAGAGGGA | 1977-1999 |
| AD-1223032.1 | A-2282443.1 | 3063 | CUCUUGGAAUUGGAUUCGCCA | 1980-2000 | A-2282444.1 | 3512 | UGGCGAAUCCAAUUCCAAGAGGG | 1978-2000 |
| AD-1223033.1 | A-2282445.1 | 3064 | UUGGAAUUGGAUUCGCCAUUA | 1983-2003 | A-2282446.1 | 3513 | UAAUGGCGAAUCCAAUUCCAAGA | 1981-2003 |
| AD-1223034.1 | A-2282447.1 | 3065 | UGGAAUUGGAUUCGCCAUUUA | 1984-2004 | A-2282448.1 | 3514 | UAAAUGGCGAAUCCAAUUCCAAG | 1982-2004 |
| AD-1223035.1 | A-2282449.1 | 3066 | GGAAUUGGAUUCGCCAUUUUA | 1985-2005 | A-2282450.1 | 3515 | UAAAAUGGCGAAUCCAAUUCCAA | 1983-2005 |
| AD-1223036.1 | A-2282451.1 | 3067 | GAAUUGGAUUCGCCAUUUUAA | 1986-2006 | A-2282452.1 | 3516 | UUAAAAUGGCGAAUCCAAUUCCA | 1984-2006 |
| AD-1223037.1 | A-2282453.1 | 3068 | AAUUGGAUUCGCCAUUUUAUA | 1987-2007 | A-2282454.1 | 3517 | UAUAAAAUGGCGAAUCCAAUUCC | 1985-2007 |
| AD-1223038.1 | A-2282455.1 | 3069 | AUUGGAUUCGCCAUUUUAUUA | 1988-2008 | A-2282456.1 | 3518 | UAAUAAAAUGGCGAAUCCAAUUC | 1986-2008 |
| AD-1223039.1 | A-2282457.1 | 3070 | UUGGAUUCGCCAUUUUAUUUA | 1989-2009 | A-2282458.1 | 3519 | UAAAUAAAAUGGCGAAUCCAAUU | 1987-2009 |
| AD-1223040.1 | A-2282459.1 | 3071 | UGGAUUCGCCAUUUUAUUUUA | 1990-2010 | A-2282460.1 | 3520 | UAAAAUAAAAUGGCGAAUCCAAU | 1988-2010 |
| AD-1223041.1 | A-2282461.1 | 3072 | GGAUUCGCCAUUUUAUUUUUA | 1991-2011 | A-2282462.1 | 3521 | UAAAAAUAAAAUGGCGAAUCCAA | 1989-2011 |
| AD-1223042.1 | A-2282463.1 | 3073 | GAUUCGCCAUUUUAUUUUUCA | 1992-2012 | A-2282464.1 | 3522 | UGAAAAAUAAAAUGGCGAAUCCA | 1990-2012 |
| AD-1223043.1 | A-2282465.1 | 3074 | UCGCCAUUUUAUUUUUCUUGA | 1995-2015 | A-2282466.1 | 3523 | UCAAGAAAAAUAAAAUGGCGAAU | 1993-2015 |
| AD-1223044.1 | A-2282467.1 | 3075 | CGCCAUUUUAUUUUUCUUGCA | 1996-2016 | A-2282468.1 | 3524 | UGCAAGAAAAAUAAAAUGGCGAA | 1994-2016 |
| AD-1223045.1 | A-2282469.1 | 3076 | GCCAUUUUAUUUUUCUUGCUA | 1997-2017 | A-2282470.1 | 3525 | UAGCAAGAAAAAUAAAAUGGCGA | 1995-2017 |
| AD-1223046.1 | A-2282471.1 | 3077 | CCAUUUUAUUUUUCUUGCUGA | 1998-2018 | A-2282472.1 | 3526 | UCAGCAAGAAAAAUAAAAUGGCG | 1996-2018 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
|---|---|---|---|---|---|---|---|---|
| AD-1223047.1 | A-2282473.1 | 3078 | CAUUUUAUUUUUCUUGCUGCA | 1999-2019 | A-2282474.1 | 3527 | UGCAGCAAGAAAAAUAAAAUGGC | 1997-2019 |
| AD-1223048.1 | A-2282475.1 | 3079 | AUUUUAUUUUUCUUGCUGCUA | 2000-2020 | A-2282476.1 | 3528 | UAGCAGCAAGAAAAAUAAAAUGG | 1998-2020 |
| AD-1223049.1 | A-2282477.1 | 3080 | UUUUAUUUUUCUUGCUGCUAA | 2001-2021 | A-2282478.1 | 3529 | UUAGCAGCAAGAAAAAUAAAAUG | 1999-2021 |
| AD-1223050.1 | A-2282479.1 | 3081 | UUUCUUGCUGCUAAAUCACCA | 2008-2028 | A-2282480.1 | 3530 | UGGUGAUUUAGCAGCAAGAAAAA | 2006-2028 |
| AD-1223051.1 | A-2282481.1 | 3082 | UCACCGAGCCCGGAAGAUUAA | 2023-2043 | A-2282482.1 | 3531 | UUAAUCUUCCGGGCUCGGUGAUU | 2021-2043 |
| AD-1223052.1 | A-2282483.1 | 3083 | GCCCGGAAGAUUAGAGAGUUA | 2030-2050 | A-2282484.1 | 3532 | UAACUCUCUAAUCUUCCGGGCUC | 2028-2050 |
| AD-1223053.1 | A-2282485.1 | 3084 | CCCGGAAGAUUAGAGAGUUUA | 2031-2051 | A-2282486.1 | 3533 | UAAACUCUCUAAUCUUCCGGGCU | 2029-2051 |
| AD-1223054.1 | A-2282487.1 | 3085 | CGGAAGAUUAGAGAGUUUUAA | 2033-2053 | A-2282488.1 | 3534 | UUAAAACUCUCUAAUCUUCCGGG | 2031-2053 |
| AD-1223055.1 | A-2282489.1 | 3086 | GGAAGAUUAGAGAGUUUUAUA | 2034-2054 | A-2282490.1 | 3535 | UAUAAAACUCUCUAAUCUUCCGG | 2032-2054 |
| AD-1223056.1 | A-2282491.1 | 3087 | GAAGAUUAGAGAGUUUUAUUA | 2035-2055 | A-2282492.1 | 3536 | UAAUAAAACUCUCUAAUCUUCCG | 2033-2055 |
| AD-1223057.1 | A-2282493.1 | 3088 | AAGAUUAGAGAGUUUUAUUUA | 2036-2056 | A-2282494.1 | 3537 | UAAAUAAAACUCUCUAAUCUUCC | 2034-2056 |
| AD-1223058.1 | A-2282495.1 | 3089 | AGAUUAGAGAGUUUUAUUUCA | 2037-2057 | A-2282496.1 | 3538 | UGAAAUAAAACUCUCUAAUCUUC | 2035-2057 |
| AD-1223059.1 | A-2282497.1 | 3090 | AUUAGAGAGUUUUAUUUCUGA | 2039-2059 | A-2282498.1 | 3539 | UCAGAAAUAAAACUCUCUAAUCU | 2037-2059 |
| AD-1223060.1 | A-2282499.1 | 3091 | UUAGAGAGUUUUAUUUCUGGA | 2040-2060 | A-2282500.1 | 3540 | UCCAGAAAUAAAACUCUCUAAUC | 2038-2060 |
| AD-1223061.1 | A-2282501.1 | 3092 | UAGAGAGUUUUAUUUCUGGGA | 2041-2061 | A-2282502.1 | 3541 | UCCCAGAAAUAAAACUCUCUAAU | 2039-2061 |
| AD-1223062.1 | A-2282503.1 | 3093 | AGAGAGUUUUAUUUCUGGGAA | 2042-2062 | A-2282504.1 | 3542 | UUCCCAGAAAUAAAACUCUCUAA | 2040-2062 |
| AD-1223063.1 | A-2282505.1 | 3094 | GAGAGUUUUAUUUCUGGGAUA | 2043-2063 | A-2282506.1 | 3543 | UAUCCCAGAAAUAAAACUCUCUA | 2041-2063 |
| AD-1223064.1 | A-2282507.1 | 3095 | AGAGUUUUAUUUCUGGGAUUA | 2044-2064 | A-2282508.1 | 3544 | UAAUCCCAGAAAUAAAACUCUCU | 2042-2064 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1223065.1 | A-2282509.1 | 3096 | GAGUUUUAUUUCUGGGAUUCA | 2045-2065 | A-2282510.1 | 3545 | UGAAUCCCAGAAAUAAAACUCUC | 2043-2065 |
| AD-1223066.1 | A-2282511.1 | 3097 | AGUUUUAUUUCUGGGAUUCCA | 2046-2066 | A-2282512.1 | 3546 | UGGAAUCCCAGAAAUAAAACUCU | 2044-2066 |
| AD-1223067.1 | A-2282513.1 | 3098 | GUUUUAUUUCUGGGAUUCCUA | 2047-2067 | A-2282514.1 | 3547 | UAGGAAUCCCAGAAAUAAAACUC | 2045-2067 |
| AD-1223068.1 | A-2282515.1 | 3099 | UUUUAUUUCUGGGAUUCCUGA | 2048-2068 | A-2282516.1 | 3548 | UCAGGAAUCCCAGAAAUAAAACU | 2046-2068 |
| AD-1223069.1 | A-2282517.1 | 3100 | UUUAUUUCUGGGAUUCCUGUA | 2049-2069 | A-2282518.1 | 3549 | UACAGGAAUCCCAGAAAUAAAAC | 2047-2069 |
| AD-1223070.1 | A-2282519.1 | 3101 | UUAUUUCUGGGAUUCCUGUAA | 2050-2070 | A-2282520.1 | 3550 | UUACAGGAAUCCCAGAAAUAAAA | 2048-2070 |
| AD-1223071.1 | A-2282521.1 | 3102 | UAUUUCUGGGAUUCCUGUAGA | 2051-2071 | A-2282522.1 | 3551 | UCUACAGGAAUCCCAGAAAUAAA | 2049-2071 |
| AD-1223072.1 | A-2282523.1 | 3103 | AUUUCUGGGAUUCCUGUAGAA | 2052-2072 | A-2282524.1 | 3552 | UUCUACAGGAAUCCCAGAAAUAA | 2050-2072 |
| AD-1223073.1 | A-2282525.1 | 3104 | UUUCUGGGAUUCCUGUAGACA | 2053-2073 | A-2282526.1 | 3553 | UGUCUACAGGAAUCCCAGAAAUA | 2051-2073 |
| AD-1223074.1 | A-2282527.1 | 3105 | UCUGGGAUUCCUGUAGACACA | 2055-2075 | A-2282528.1 | 3554 | UGUGUCUACAGGAAUCCCAGAAA | 2053-2075 |
| AD-1223075.1 | A-2282529.1 | 3106 | CUGGGAUUCCUGUAGACACAA | 2056-2076 | A-2282530.1 | 3555 | UUGUGUCUACAGGAAUCCCAGAA | 2054-2076 |
| AD-1223076.1 | A-2282531.1 | 3107 | UGGGAUUCCUGUAGACACACA | 2057-2077 | A-2282532.1 | 3556 | UGUGUGUCUACAGGAAUCCCAGA | 2055-2077 |
| AD-1223077.1 | A-2282533.1 | 3108 | GGGAUUCCUGUAGACACACCA | 2058-2078 | A-2282534.1 | 3557 | UGGUGUGUCUACAGGAAUCCCAG | 2056-2078 |
| AD-1223078.1 | A-2282535.1 | 3109 | ACACACCCACCCACAUACAUA | 2071-2091 | A-2282536.1 | 3558 | UAUGUAUGUGGGUGGGUGUGUCU | 2069-2091 |
| AD-1223079.1 | A-2282537.1 | 3110 | ACCCACCCACAUACAUACAUA | 2075-2095 | A-2282538.1 | 3559 | UAUGUAUGUAUGUGGGUGGGUGU | 2073-2095 |
| AD-1223080.1 | A-2282539.1 | 3111 | CCCACCCACAUACAUACAUUA | 2076-2096 | A-2282540.1 | 3560 | UAAUGUAUGUAUGUGGGUGGGUG | 2074-2096 |
| AD-1223081.1 | A-2282541.1 | 3112 | CCACCCACAUACAUACAUUUA | 2077-2097 | A-2282542.1 | 3561 | UAAAUGUAUGUAUGUGGGUGGGU | 2075-2097 |
| AD-1223082.1 | A-2282543.1 | 3113 | CACCCACAUACAUACAUUUAA | 2078-2098 | A-2282544.1 | 3562 | UUAAAUGUAUGUAUGUGGGUGGG | 2076-2098 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
|---|---|---|---|---|---|---|---|---|
| AD-1223083.1 | A-2282545.1 | 3114 | CCACAUACAUACAUUUAUAUA | 2081-2101 | A-2282546.1 | 3563 | UAUAUAAAUGUAUGUAUGUGGGU | 2079-2101 |
| AD-1223084.1 | A-2282547.1 | 3115 | CACAUACAUACAUUUAUAUAA | 2082-2102 | A-2282548.1 | 3564 | UUAUAUAAAUGUAUGUAUGUGGG | 2080-2102 |
| AD-1223085.1 | A-2282549.1 | 3116 | UUAAAUUAACAGUGCUAAUGA | 2171-2191 | A-2282550.1 | 3565 | UCAUUAGCACUGUUAAUUUAAAA | 2169-2191 |
| AD-1223086.1 | A-2282551.1 | 3117 | UAAAUUAACAGUGCUAAUGUA | 2172-2192 | A-2282552.1 | 3566 | UACAUUAGCACUGUUAAUUUAAA | 2170-2192 |
| AD-1223087.1 | A-2282553.1 | 3118 | AAAUUAACAGUGCUAAUGUUA | 2173-2193 | A-2282554.1 | 3567 | UAACAUUAGCACUGUUAAUUUAA | 2171-2193 |
| AD-1223088.1 | A-2282555.1 | 3119 | AAUUAACAGUGCUAAUGUUAA | 2174-2194 | A-2282556.1 | 3568 | UUAACAUUAGCACUGUUAAUUUA | 2172-2194 |
| AD-1223089.1 | A-2282557.1 | 3120 | AUUAACAGUGCUAAUGUUAUA | 2175-2195 | A-2282558.1 | 3569 | UAUAACAUUAGCACUGUUAAUUU | 2173-2195 |
| AD-1223090.1 | A-2282559.1 | 3121 | UUAACAGUGCUAAUGUUAUUA | 2176-2196 | A-2282560.1 | 3570 | UAAUAACAUUAGCACUGUUAAUU | 2174-2196 |
| AD-1223091.1 | A-2282561.1 | 3122 | UAACAGUGCUAAUGUUAUUGA | 2177-2197 | A-2282562.1 | 3571 | UCAAUAACAUUAGCACUGUUAAU | 2175-2197 |
| AD-1223092.1 | A-2282563.1 | 3123 | AACAGUGCUAAUGUUAUUGGA | 2178-2198 | A-2282564.1 | 3572 | UCCAAUAACAUUAGCACUGUUAA | 2176-2198 |
| AD-1223093.1 | A-2282565.1 | 3124 | ACAGUGCUAAUGUUAUUGGUA | 2179-2199 | A-2282566.1 | 3573 | UACCAAUAACAUUAGCACUGUUA | 2177-2199 |
| AD-1223094.1 | A-2282567.1 | 3125 | CAGUGCUAAUGUUAUUGGUGA | 2180-2200 | A-2282568.1 | 3574 | UCACCAAUAACAUUAGCACUGUU | 2178-2200 |
| AD-1223095.1 | A-2282569.1 | 3126 | GUGCUAAUGUUAUUGGUGUCA | 2182-2202 | A-2282570.1 | 3575 | UGACACCAAUAACAUUAGCACUG | 2180-2202 |
| AD-1223096.1 | A-2282571.1 | 3127 | UGCUAAUGUUAUUGGUGUCUA | 2183-2203 | A-2282572.1 | 3576 | UAGACACCAAUAACAUUAGCACU | 2181-2203 |
| AD-1223097.1 | A-2282573.1 | 3128 | GCUAAUGUUAUUGGUGUCUUA | 2184-2204 | A-2282574.1 | 3577 | UAAGACACCAAUAACAUUAGCAC | 2182-2204 |
| AD-1223098.1 | A-2282575.1 | 3129 | CUAAUGUUAUUGGUGUCUUCA | 2185-2205 | A-2282576.1 | 3578 | UGAAGACACCAAUAACAUUAGCA | 2183-2205 |
| AD-1223099.1 | A-2282577.1 | 3130 | UAAUGUUAUUGGUGUCUUCAA | 2186-2206 | A-2282578.1 | 3579 | UUGAAGACACCAAUAACAUUAGC | 2184-2206 |
| AD-1223100.1 | A-2282579.1 | 3131 | AAUGUUAUUGGUGUCUUCACA | 2187-2207 | A-2282580.1 | 3580 | UGUGAAGACACCAAUAACAUUAG | 2185-2207 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
|---|---|---|---|---|---|---|---|---|
| AD-1223101.1 | A-2282581.1 | 3132 | AUGUUAUUGGUGUCUUCACUA | 2188-2208 | A-2282582.1 | 3581 | UAGUGAAGACACCAAUAACAUUA | 2186-2208 |
| AD-1223102.1 | A-2282583.1 | 3133 | UGUUAUUGGUGUCUUCACUGA | 2189-2209 | A-2282584.1 | 3582 | UCAGUGAAGACACCAAUAACAUU | 2187-2209 |
| AD-1223103.1 | A-2282585.1 | 3134 | GUUAUUGGUGUCUUCACUGGA | 2190-2210 | A-2282586.1 | 3583 | UCCAGUGAAGACACCAAUAACAU | 2188-2210 |
| AD-1223104.1 | A-2282587.1 | 3135 | UUAUUGGUGUCUUCACUGGAA | 2191-2211 | A-2282588.1 | 3584 | UUCCAGUGAAGACACCAAUAACA | 2189-2211 |
| AD-1223105.1 | A-2282589.1 | 3136 | UGGUGUCUUCACUGGAUGUAA | 2195-2215 | A-2282590.1 | 3585 | UUACAUCCAGUGAAGACACCAAU | 2193-2215 |
| AD-1223106.1 | A-2282591.1 | 3137 | UGUCUUCACUGGAUGUAUUUA | 2198-2218 | A-2282592.1 | 3586 | UAAAUACAUCCAGUGAAGACACC | 2196-2218 |
| AD-1223107.1 | A-2282593.1 | 3138 | CACUGGAUGUAUUUGACUGCA | 2204-2224 | A-2282594.1 | 3587 | UGCAGUCAAAUACAUCCAGUGAA | 2202-2224 |
| AD-1223108.1 | A-2282595.1 | 3139 | ACUGGAUGUAUUUGACUGCUA | 2205-2225 | A-2282596.1 | 3588 | UAGCAGUCAAAUACAUCCAGUGA | 2203-2225 |
| AD-1223109.1 | A-2282597.1 | 3140 | UGGAUGUAUUUGACUGCUGUA | 2207-2227 | A-2282598.1 | 3589 | UACAGCAGUCAAAUACAUCCAGU | 2205-2227 |
| AD-1223110.1 | A-2282599.1 | 3141 | UAUUUGACUGCUGUGGACUUA | 2213-2233 | A-2282600.1 | 3590 | UAAGUCCACAGCAGUCAAAUACA | 2211-2233 |
| AD-1223111.1 | A-2282601.1 | 3142 | UUUGACUGCUGUGGACUUGAA | 2215-2235 | A-2282602.1 | 3591 | UUCAAGUCCACAGCAGUCAAAUA | 2213-2235 |
| AD-1223112.1 | A-2282603.1 | 3143 | GCUGUGGACUUGAGUUGGGAA | 2222-2242 | A-2282604.1 | 3592 | UUCCCAACUCAAGUCCACAGCAG | 2220-2242 |
| AD-1223113.1 | A-2282605.1 | 3144 | UCCCACUCAGAUCCUGACAGA | 2251-2271 | A-2282606.1 | 3593 | UCUGUCAGGAUCUGAGUGGGAAC | 2249-2271 |
| AD-1223114.1 | A-2282607.1 | 3145 | CCCACUCAGAUCCUGACAGGA | 2252-2272 | A-2282608.1 | 3594 | UCCUGUCAGGAUCUGAGUGGGAA | 2250-2272 |
| AD-1223115.1 | A-2282609.1 | 3146 | GGAGGAGAUGAGAGACUCUGA | 2277-2297 | A-2282610.1 | 3595 | UCAGAGUCUCUCAUCUCCUCCUC | 2275-2297 |
| AD-1223116.1 | A-2282611.1 | 3147 | GAGGAGAUGAGAGACUCUGGA | 2278-2298 | A-2282612.1 | 3596 | UCCAGAGUCUCUCAUCUCCUCCU | 2276-2298 |
| AD-1223117.1 | A-2282613.1 | 3148 | GGAGAUGAGAGACUCUGGCAA | 2280-2300 | A-2282614.1 | 3597 | UUGCCAGAGUCUCUCAUCUCCUC | 2278-2300 |
| AD-1223118.1 | A-2282615.1 | 3149 | GAGACUCUGGCAUGAUCUUUA | 2288-2308 | A-2282616.1 | 3598 | UAAAGAUCAUGCCAGAGUCUCUC | 2286-2308 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1223119.1 | A-2282617.1 | 3150 | AGACUCUGGCAUGAUCUUUUA | 2289-2309 | A-2282618.1 | 3599 | UAAAAGAUCAUGCCAGAGUCUCU | 2287-2309 |
| AD-1223120.1 | A-2282619.1 | 3151 | UUUUGGGAACACCGACAAACA | 2392-2412 | A-2282620.1 | 3600 | UGUUUGUCGGUGUUCCCAAAACU | 2390-2412 |
| AD-1223121.1 | A-2282621.1 | 3152 | GAGCUUCAGGACAUUGCUGUA | 2511-2531 | A-2282622.1 | 3601 | UACAGCAAUGUCCUGAAGCUCCC | 2509-2531 |
| AD-1223122.1 | A-2282623.1 | 3153 | GCUUCAGGACAUUGCUGUGCA | 2513-2533 | A-2282624.1 | 3602 | UGCACAGCAAUGUCCUGAAGCUC | 2511-2533 |
| AD-1223123.1 | A-2282625.1 | 3154 | CUUCAGGACAUUGCUGUGCUA | 2514-2534 | A-2282626.1 | 3603 | UAGCACAGCAAUGUCCUGAAGCU | 2512-2534 |
| AD-1223124.1 | A-2282627.1 | 3155 | UUCAGGACAUUGCUGUGCUUA | 2515-2535 | A-2282628.1 | 3604 | UAAGCACAGCAAUGUCCUGAAGC | 2513-2535 |
| AD-1223125.1 | A-2282629.1 | 3156 | UCAGGACAUUGCUGUGCUUUA | 2516-2536 | A-2282630.1 | 3605 | UAAAGCACAGCAAUGUCCUGAAG | 2514-2536 |
| AD-1223126.1 | A-2282631.1 | 3157 | CAGGACAUUGCUGUGCUUUGA | 2517-2537 | A-2282632.1 | 3606 | UCAAAGCACAGCAAUGUCCUGAA | 2515-2537 |
| AD-1223127.1 | A-2282633.1 | 3158 | CGCUUACUCUCACCUGCUUCA | 2615-2635 | A-2282634.1 | 3607 | UGAAGCAGGUGAGAGUAAGCGAA | 2613-2635 |
| AD-1223128.1 | A-2282635.1 | 3159 | GCUUACUCUCACCUGCUUCUA | 2616-2636 | A-2282636.1 | 3608 | UAGAAGCAGGUGAGAGUAAGCGA | 2614-2636 |
| AD-1223129.1 | A-2282637.1 | 3160 | UUACUCUCACCUGCUUCUGAA | 2618-2638 | A-2282638.1 | 3609 | UUCAGAAGCAGGUGAGAGUAAGC | 2616-2638 |
| AD-1223130.1 | A-2282639.1 | 3161 | CUCUCACCUGCUUCUGAGUUA | 2621-2641 | A-2282640.1 | 3610 | UAACUCAGAAGCAGGUGAGAGUA | 2619-2641 |
| AD-1223131.1 | A-2282641.1 | 3162 | UCUCACCUGCUUCUGAGUUGA | 2622-2642 | A-2282642.1 | 3611 | UCAACUCAGAAGCAGGUGAGAGU | 2620-2642 |
| AD-1223132.1 | A-2282643.1 | 3163 | CUCACCUGCUUCUGAGUUGCA | 2623-2643 | A-2282644.1 | 3612 | UGCAACUCAGAAGCAGGUGAGAG | 2621-2643 |
| AD-1223133.1 | A-2282645.1 | 3164 | UCACCUGCUUCUGAGUUGCCA | 2624-2644 | A-2282646.1 | 3613 | UGGCAACUCAGAAGCAGGUGAGA | 2622-2644 |
| AD-1223134.1 | A-2282647.1 | 3165 | CACCUGCUUCUGAGUUGCCCA | 2625-2645 | A-2282648.1 | 3614 | UGGGCAACUCAGAAGCAGGUGAG | 2623-2645 |
| AD-1223135.1 | A-2282649.1 | 3166 | ACCUGCUUCUGAGUUGCCCAA | 2626-2646 | A-2282650.1 | 3615 | UUGGGCAACUCAGAAGCAGGUGA | 2624-2646 |
| AD-1223136.1 | A-2282651.1 | 3167 | CCUGCUUCUGAGUUGCCCAGA | 2627-2647 | A-2282652.1 | 3616 | UCUGGGCAACUCAGAAGCAGGUG | 2625-2647 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1223137.1 | A-2282653.1 | 3168 | CGGCGAAGAGAAGAGACACAA | 2667-2687 | A-2282654.1 | 3617 | UUGUGUCUCUUCUCUUCGCCGGG | 2665-2687 |
| AD-1223138.1 | A-2282655.1 | 3169 | GGCGAAGAGAAGAGACACAUA | 2668-2688 | A-2282656.1 | 3618 | UAUGUGUCUCUUCUCUUCGCCGG | 2666-2688 |
| AD-1223139.1 | A-2282657.1 | 3170 | GCGAAGAGAAGAGACACAUUA | 2669-2689 | A-2282658.1 | 3619 | UAAUGUGUCUCUUCUCUUCGCCG | 2667-2689 |
| AD-1223140.1 | A-2282659.1 | 3171 | CGAAGAGAAGAGACACAUUGA | 2670-2690 | A-2282660.1 | 3620 | UCAAUGUGUCUCUUCUCUUCGCC | 2668-2690 |
| AD-1223141.1 | A-2282661.1 | 3172 | GAAGAGAAGAGACACAUUGUA | 2671-2691 | A-2282662.1 | 3621 | UACAAUGUGUCUCUUCUCUUCGC | 2669-2691 |
| AD-1223142.1 | A-2282663.1 | 3173 | AAGAGAAGAGACACAUUGUUA | 2672-2692 | A-2282664.1 | 3622 | UAACAAUGUGUCUCUUCUCUUCG | 2670-2692 |
| AD-1223143.1 | A-2282665.1 | 3174 | AGAGAAGAGACACAUUGUUGA | 2673-2693 | A-2282666.1 | 3623 | UCAACAAUGUGUCUCuucucuuc | 2671-2693 |
| AD-1223144.1 | A-2282667.1 | 3175 | GAGAAGAGACACAUUGUUGGA | 2674-2694 | A-2282668.1 | 3624 | UCCAACAAUGUGUCUcuucucuu | 2672-2694 |
| AD-1223145.1 | A-2282669.1 | 3176 | AGAAGAGACACAUUGUUGGAA | 2675-2695 | A-2282670.1 | 3625 | UUCCAACAAUGUGUCUCUUCUCU | 2673-2695 |
| AD-1223146.1 | A-2282671.1 | 3177 | GAAGAGACACAUUGUUGGAAA | 2676-2696 | A-2282672.1 | 3626 | UUUCCAACAAUGUGUCUCUUCUC | 2674-2696 |
| AD-1223147.1 | A-2282673.1 | 3178 | AAGAGACACAUUGUUGGAAGA | 2677-2697 | A-2282674.1 | 3627 | UCUUCCAACAAUGUGUCUCUUCU | 2675-2697 |
| AD-1223148.1 | A-2282675.1 | 3179 | AGAGACACAUUGUUGGAAGAA | 2678-2698 | A-2282676.1 | 3628 | UUCUUCCAACAAUGUGUCUCUUC | 2676-2698 |
| AD-1223149.1 | A-2282677.1 | 3180 | GAGACACAUUGUUGGAAGAAA | 2679-2699 | A-2282678.1 | 3629 | UUUCUUCCAACAAUGUGUCUCUU | 2677-2699 |
| AD-1223150.1 | A-2282679.1 | 3181 | AGACACAUUGUUGGAAGAAGA | 2680-2700 | A-2282680.1 | 3630 | UCUUCUUCCAACAAUGUGUCUCU | 2678-2700 |
| AD-1223151.1 | A-2282681.1 | 3182 | GACACAUUGUUGGAAGAAGCA | 2681-2701 | A-2282682.1 | 3631 | UGCUUCUUCCAACAAUGUGUCUC | 2679-2701 |
| AD-1223152.1 | A-2282683.1 | 3183 | ACACAUUGUUGGAAGAAGCAA | 2682-2702 | A-2282684.1 | 3632 | UUGCUUCUUCCAACAAUGUGUCU | 2680-2702 |
| AD-1223153.1 | A-2282685.1 | 3184 | CACAUUGUUGGAAGAAGCAGA | 2683-2703 | A-2282686.1 | 3633 | UCUGCUUCUUCCAACAAUGUGUC | 2681-2703 |
| AD-1223154.1 | A-2282687.1 | 3185 | UAUGUCCUCACACCAUUGAAA | 2781-2801 | A-2282688.1 | 3634 | UUUCAAUGGUGUGAGGACAUAGG | 2779-2801 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1223155.1 | A-2282689.1 | 3186 | UCCUCACACCAUUGAAACCAA | 2785-2805 | A-2282690.1 | 3635 | UUGGUUUCAAUGGUGUGAGGACA | 2783-2805 |
| AD-1223156.1 | A-2282691.1 | 3187 | CCUCACACCAUUGAAACCACA | 2786-2806 | A-2282692.1 | 3636 | UGUGGUUUCAAUGGUGUGAGGAC | 2784-2806 |
| AD-1223157.1 | A-2282693.1 | 3188 | CUCACACCAUUGAAACCACUA | 2787-2807 | A-2282694.1 | 3637 | UAGUGGUUUCAAUGGUGUGAGGA | 2785-2807 |
| AD-1223158.1 | A-2282695.1 | 3189 | UCACACCAUUGAAACCACUAA | 2788-2808 | A-2282696.1 | 3638 | UUAGUGGUUUCAAUGGUGUGAGG | 2786-2808 |
| AD-1223159.1 | A-2282697.1 | 3190 | CACACCAUUGAAACCACUAGA | 2789-2809 | A-2282698.1 | 3639 | UCUAGUGGUUUCAAUGGUGUGAG | 2787-2809 |
| AD-1223160.1 | A-2282699.1 | 3191 | CCAUUGAAACCACUAGUUCUA | 2793-2813 | A-2282700.1 | 3640 | UAGAACUAGUGGUUUCAAUGGUG | 2791-2813 |
| AD-1223161.1 | A-2282701.1 | 3192 | CAUUGAAACCACUAGUUCUGA | 2794-2814 | A-2282702.1 | 3641 | UCAGAACUAGUGGUUUCAAUGGU | 2792-2814 |
| AD-1223162.1 | A-2282703.1 | 3193 | AUUGAAACCACUAGUUCUGUA | 2795-2815 | A-2282704.1 | 3642 | UACAGAACUAGUGGUUUCAAUGG | 2793-2815 |
| AD-1223163.1 | A-2282705.1 | 3194 | UUGAAACCACUAGUUCUGUCA | 2796-2816 | A-2282706.1 | 3643 | UGACAGAACUAGUGGUUUCAAUG | 2794-2816 |
| AD-1223164.1 | A-2282707.1 | 3195 | UGAAACCACUAGUUCUGUCCA | 2797-2817 | A-2282708.1 | 3644 | UGGACAGAACUAGUGGUUUCAAU | 2795-2817 |
| AD-1223165.1 | A-2282709.1 | 3196 | GACCUGGUUGUGUGUGUGUGA | 2825-2845 | A-2282710.1 | 3645 | UCACACACACACAACCAGGUCUC | 2823-2845 |
| AD-1223166.1 | A-2282711.1 | 3197 | ACCUGGUUGUGUGUGUGUGAA | 2826-2846 | A-2282712.1 | 3646 | UUCACACACACACAACCAGGUCU | 2824-2846 |
| AD-1223167.1 | A-2282713.1 | 3198 | CCUGGUUGUGUGUGUGUGAGA | 2827-2847 | A-2282714.1 | 3647 | UCUCACACACACACAACCAGGUC | 2825-2847 |
| AD-1223168.1 | A-2282715.1 | 3199 | CUGGUUGUGUGUGUGUGAGUA | 2828-2848 | A-2282716.1 | 3648 | UACUCACACACACACAACCAGGU | 2826-2848 |
| AD-1223169.1 | A-2282717.1 | 3200 | UGGUUGUGUGUGUGUGAGUGA | 2829-2849 | A-2282718.1 | 3649 | UCACUCACACACACACAACCAGG | 2827-2849 |
| AD-1223170.1 | A-2282719.1 | 3201 | GGUUGUGUGUGUGUGAGUGGA | 2830-2850 | A-2282720.1 | 3650 | UCCACUCACACACACACAACCAG | 2828-2850 |
| AD-1223171.1 | A-2282721.1 | 3202 | GUGUGUGUGUGAGUGGUUGAA | 2834-2854 | A-2282722.1 | 3651 | UUCAACCACUCACACACACACAA | 2832-2854 |
| AD-1223172.1 | A-2282723.1 | 3203 | UGUGUGUGUGAGUGGUUGACA | 2835-2855 | A-2282724.1 | 3652 | UGUCAACCACUCACACACACACA | 2833-2855 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1223173.1 | A-2282725.1 | 3204 | UGUGUGUGAGUGGUUGACCUA | 2837-2857 | A-2282726.1 | 3653 | UAGGUCAACCACUCACACACA | 2835-2857 |
| AD-1223174.1 | A-2282727.1 | 3205 | UGUGUGAGUGGUUGACCUUCA | 2839-2859 | A-2282728.1 | 3654 | UGAAGGUCAACCACUCACACA | 2837-2859 |
| AD-1223175.1 | A-2282729.1 | 3206 | GUGUGAGUGGUUGACCUUCCA | 2840-2860 | A-2282730.1 | 3655 | UGGAAGGUCAACCACUCACAC | 2838-2860 |
| AD-1223176.1 | A-2282731.1 | 3207 | UGUGAGUGGUUGACCUUCCUA | 2841-2861 | A-2282732.1 | 3656 | UAGGAAGGUCAACCACUCACA | 2839-2861 |
| AD-1223177.1 | A-2282733.1 | 3208 | UGAGUGGUUGACCUUCCUCCA | 2843-2863 | A-2282734.1 | 3657 | UGGAGGAAGGUCAACCACUCA | 2841-2863 |
| AD-1223178.1 | A-2282735.1 | 3209 | GUGGUUGACCUUCCUCCAUCA | 2846-2866 | A-2282736.1 | 3658 | UGAUGGAGGAAGGUCAACCACUC | 2844-2866 |
| AD-1223179.1 | A-2282737.1 | 3210 | UUGUGGAGGCAGAGAAAAGAA | 2926-2946 | A-2282738.1 | 3659 | UUCUUUUCUCUGCCUCCACAAUG | 2924-2946 |
| AD-1223180.1 | A-2282739.1 | 3211 | UGUGGAGGCAGAGAAAAGAGA | 2927-2947 | A-2282740.1 | 3660 | UCUCUUUUCUCUGCCUCCACAAU | 2925-2947 |
| AD-1223181.1 | A-2282741.1 | 3212 | GUGGAGGCAGAGAAAAGAGAA | 2928-2948 | A-2282742.1 | 3661 | UUCUCUUUUCUCUGCCUCCACAA | 2926-2948 |
| AD-1223182.1 | A-2282743.1 | 3213 | UGGAGGCAGAGAAAAGAGAAA | 2929-2949 | A-2282744.1 | 3662 | UUUCUCUUUUCUCUGCCUCCACA | 2927-2949 |
| AD-1223183.1 | A-2282745.1 | 3214 | GGAGGCAGAGAAAAGAGAAAA | 2930-2950 | A-2282746.1 | 3663 | UUUUCUCUUUUCUCUGCCUCCAC | 2928-2950 |
| AD-1223184.1 | A-2282747.1 | 3215 | GAGGCAGAGAAAAGAGAAAGA | 2931-2951 | A-2282748.1 | 3664 | UCUUUCUCUUUUCUCUGCCUCCA | 2929-2951 |
| AD-1223185.1 | A-2282749.1 | 3216 | AGGCAGAGAAAAGAGAAAGUA | 2932-2952 | A-2282750.1 | 3665 | UACUUUCUCUUUUCUCUGCCUCC | 2930-2952 |
| AD-1223186.1 | A-2282751.1 | 3217 | GGCAGAGAAAAGAGAAAGUGA | 2933-2953 | A-2282752.1 | 3666 | UCACUUUCUCUUUUCUCUGCCUC | 2931-2953 |
| AD-1223187.1 | A-2282753.1 | 3218 | GCAGAGAAAAGAGAAAGUGUA | 2934-2954 | A-2282754.1 | 3667 | UACACUUUCUCUUUUCUCUGCCU | 2932-2954 |
| AD-1223188.1 | A-2282755.1 | 3219 | CAGAGAAAAGAGAAAGUGUUA | 2935-2955 | A-2282756.1 | 3668 | UAACACUUUCUCUUUUCUCUGCC | 2933-2955 |
| AD-1223189.1 | A-2282757.1 | 3220 | AGAGAAAAGAGAAAGUGUUUA | 2936-2956 | A-2282758.1 | 3669 | UAAACACUUUCUCUUUUCUCUGC | 2934-2956 |
| AD-1223190.1 | A-2282759.1 | 3221 | GAGAAAAGAGAAAGUGUUUUA | 2937-2957 | A-2282760.1 | 3670 | UAAAACACUUUCUCUUUUCUCUG | 2935-2957 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1223191.1 | A-2282761.1 | 3222 | AGAAAAGAGAAAGUGUUUUAA | 2938-2958 | A-2282762.1 | 3671 | UUAAAACACUUUCUCUUUUCUCU | 2936-2958 |
| AD-1223192.1 | A-2282763.1 | 3223 | GAAAAGAGAAAGUGUUUUAUA | 2939-2959 | A-2282764.1 | 3672 | UAUAAAACACUUUCUCUUUUCUC | 2937-2959 |
| AD-1223193.1 | A-2282765.1 | 3224 | AAAAGAGAAAGUGUUUUAUAA | 2940-2960 | A-2282766.1 | 3673 | UUAUAAAACACUUUCUCUUUUCU | 2938-2960 |
| AD-1223194.1 | A-2282767.1 | 3225 | AAAGAGAAAGUGUUUUAUAUA | 2941-2961 | A-2282768.1 | 3674 | UAUAUAAAACACUUUCUCUUUUC | 2939-2961 |
| AD-1223195.1 | A-2282769.1 | 3226 | AAGAGAAAGUGUUUUAUAUAA | 2942-2962 | A-2282770.1 | 3675 | UUAUAUAAAACACUUUCUCUUUU | 2940-2962 |
| AD-1223196.1 | A-2282771.1 | 3227 | AGAGAAAGUGUUUUAUAUACA | 2943-2963 | A-2282772.1 | 3676 | UGUAUAUAAAACACUUUCUCUUU | 2941-2963 |
| AD-1223197.1 | A-2282773.1 | 3228 | GAGAAAGUGUUUUAUAUACGA | 2944-2964 | A-2282774.1 | 3677 | UCGUAUAUAAAACACUUUCUCUU | 2942-2964 |
| AD-1223198.1 | A-2282775.1 | 3229 | AGAAAGUGUUUUAUAUACGGA | 2945-2965 | A-2282776.1 | 3678 | UCCGUAUAUAAAACACUUUCUCU | 2943-2965 |
| AD-1223199.1 | A-2282777.1 | 3230 | AAAGUGUUUUAUAUACGGUAA | 2947-2967 | A-2282778.1 | 3679 | UUACCGUAUAUAAAACACUUUCU | 2945-2967 |
| AD-1223200.1 | A-2282779.1 | 3231 | AAGUGUUUUAUAUACGGUACA | 2948-2968 | A-2282780.1 | 3680 | UGUACCGUAUAUAAAACACUUUC | 2946-2968 |
| AD-1223201.1 | A-2282781.1 | 3232 | AGUGUUUUAUAUACGGUACUA | 2949-2969 | A-2282782.1 | 3681 | UAGUACCGUAUAUAAAACACUUU | 2947-2969 |
| AD-1223202.1 | A-2282783.1 | 3233 | GUGUUUUAUAUACGGUACUUA | 2950-2970 | A-2282784.1 | 3682 | UAAGUACCGUAUAUAAAACACUU | 2948-2970 |
| AD-1223203.1 | A-2282785.1 | 3234 | UGUUUUAUAUACGGUACUUAA | 2951-2971 | A-2282786.1 | 3683 | UUAAGUACCGUAUAUAAAACACU | 2949-2971 |
| AD-1223204.1 | A-2282787.1 | 3235 | GUUUUAUAUACGGUACUUAUA | 2952-2972 | A-2282788.1 | 3684 | UAUAAGUACCGUAUAUAAAACAC | 2950-2972 |
| AD-1223205.1 | A-2282789.1 | 3236 | UUUUAUAUACGGUACUUAUUA | 2953-2973 | A-2282790.1 | 3685 | UAAUAAGUACCGUAUAUAAAACA | 2951-2973 |
| AD-1223206.1 | A-2282791.1 | 3237 | UUUAUAUACGGUACUUAUUUA | 2954-2974 | A-2282792.1 | 3686 | UAAAUAAGUACCGUAUAUAAAAC | 2952-2974 |
| AD-1223207.1 | A-2282793.1 | 3238 | UUAUAUACGGUACUUAUUUAA | 2955-2975 | A-2282794.1 | 3687 | UUAAAUAAGUACCGUAUAUAAAA | 2953-2975 |
| AD-1223208.1 | A-2282795.1 | 3239 | UAUAUACGGUACUUAUUUAAA | 2956-2976 | A-2282796.1 | 3688 | UUUAAAUAAGUACCGUAUAUAAA | 2954-2976 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1223209.1 | A-2282797.1 | 3240 | GUACUUAUUUAAUAUCCCUUA | 2964-2984 | A-2282798.1 | 3689 | UAAGGGAUAUUAAAUAAGUACCG | 2962-2984 |
| AD-1223210.1 | A-2282799.1 | 3241 | UACUUAUUUAAUAUCCCUUUA | 2965-2985 | A-2282800.1 | 3690 | UAAAGGGAUAUUAAAUAAGUACC | 2963-2985 |
| AD-1223211.1 | A-2282801.1 | 3242 | UUAUGAGAUGUAUCUUUUGCA | 3068-3088 | A-2282802.1 | 3691 | UGCAAAAGAUACAUCUCAUAAAU | 3066-3088 |
| AD-1223212.1 | A-2282803.1 | 3243 | UAUGAGAUGUAUCUUUUGCUA | 3069-3089 | A-2282804.1 | 3692 | UAGCAAAAGAUACAUCUCAUAAA | 3067-3089 |
| AD-1223213.1 | A-2282805.1 | 3244 | AUGAGAUGUAUCUUUUGCUCA | 3070-3090 | A-2282806.1 | 3693 | UGAGCAAAAGAUACAUCUCAUAA | 3068-3090 |
| AD-1223214.1 | A-2282807.1 | 3245 | UGAGAUGUAUCUUUUGCUCUA | 3071-3091 | A-2282808.1 | 3694 | UAGAGCAAAAGAUACAUCUCAUA | 3069-3091 |
| AD-1223215.1 | A-2282809.1 | 3246 | GAGAUGUAUCUUUUGCUCUCA | 3072-3092 | A-2282810.1 | 3695 | UGAGAGCAAAAGAUACAUCUCAU | 3070-3092 |
| AD-1223216.1 | A-2282811.1 | 3247 | AGAUGUAUCUUUUGCUCUCUA | 3073-3093 | A-2282812.1 | 3696 | UAGAGAGCAAAAGAUACAUCUCA | 3071-3093 |
| AD-1223217.1 | A-2282813.1 | 3248 | GAUGUAUCUUUUGCUCUCUCA | 3074-3094 | A-2282814.1 | 3697 | UGAGAGAGCAAAAGAUACAUCUC | 3072-3094 |
| AD-1223218.1 | A-2282815.1 | 3249 | AUGUAUCUUUUGCUCUCUCUA | 3075-3095 | A-2282816.1 | 3698 | UAGAGAGAGCAAAAGAUACAUCU | 3073-3095 |
| AD-1223219.1 | A-2282817.1 | 3250 | GCUCUCUCUUGCUCUCUUAUA | 3086-3106 | A-2282818.1 | 3699 | UAUAAGAGAGCAAGAGAGAGCAA | 3084-3106 |
| AD-1223220.1 | A-2282819.1 | 3251 | CUCUCUCUUGCUCUCUUAUUA | 3087-3107 | A-2282820.1 | 3700 | UAAUAAGAGAGCAAGAGAGAGCA | 3085-3107 |
| AD-1223221.1 | A-2282821.1 | 3252 | UCUCUCUUGCUCUCUUAUUUA | 3088-3108 | A-2282822.1 | 3701 | UAAAUAAGAGAGCAAGAGAGAGC | 3086-3108 |
| AD-1223222.1 | A-2282823.1 | 3253 | CUCUCUUGCUCUCUUAUUUGA | 3089-3109 | A-2282824.1 | 3702 | UCAAAUAAGAGAGCAAGAGAGAG | 3087-3109 |
| AD-1223223.1 | A-2282825.1 | 3254 | UCUCUUGCUCUCUUAUUUGUA | 3090-3110 | A-2282826.1 | 3703 | UACAAAUAAGAGAGCAAGAGAGA | 3088-3110 |
| AD-1223224.1 | A-2282827.1 | 3255 | CUCUUGCUCUCUUAUUUGUAA | 3091-3111 | A-2282828.1 | 3704 | UUACAAAUAAGAGAGCAAGAGAG | 3089-3111 |
| AD-1223225.1 | A-2282829.1 | 3256 | UCUUGCUCUCUUAUUUGUACA | 3092-3112 | A-2282830.1 | 3705 | UGUACAAAUAAGAGAGCAAGAGA | 3090-3112 |
| AD-1223226.1 | A-2282831.1 | 3257 | CUUGCUCUCUUAUUUGUACCA | 3093-3113 | A-2282832.1 | 3706 | UGGUACAAAUAAGAGAGCAAGAG | 3091-3113 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1223227.1 | A-2282833.1 | 3258 | UUGCUCUCUUAUUUGUACCGA | 3094-3114 | A-2282834.1 | 3707 | UCGGUACAAAUAAGAGAGCAAGA | 3092-3114 |
| AD-1223228.1 | A-2282835.1 | 3259 | UGCUCUCUUAUUUGUACCGGA | 3095-3115 | A-2282836.1 | 3708 | UCCGGUACAAAUAAGAGAGCAAG | 3093-3115 |
| AD-1223229.1 | A-2282837.1 | 3260 | CUCUCUUAUUUGUACCGGUUA | 3097-3117 | A-2282838.1 | 3709 | UAACCGGUACAAAUAAGAGAGCA | 3095-3117 |
| AD-1223230.1 | A-2282839.1 | 3261 | UCUCUUAUUUGUACCGGUUUA | 3098-3118 | A-2282840.1 | 3710 | UAAACCGGUACAAAUAAGAGAGC | 3096-3118 |
| AD-1223231.1 | A-2282841.1 | 3262 | CUCUUAUUUGUACCGGUUUUA | 3099-3119 | A-2282842.1 | 3711 | UAAAACCGGUACAAAUAAGAGAG | 3097-3119 |
| AD-1223232.1 | A-2282843.1 | 3263 | UCUUAUUUGUACCGGUUUUUA | 3100-3120 | A-2282844.1 | 3712 | UAAAAACCGGUACAAAUAAGAGA | 3098-3120 |
| AD-1223233.1 | A-2282845.1 | 3264 | CUUAUUUGUACCGGUUUUUGA | 3101-3121 | A-2282846.1 | 3713 | UCAAAAACCGGUACAAAUAAGAG | 3099-3121 |
| AD-1223234.1 | A-2282847.1 | 3265 | UUAUUUGUACCGGUUUUUGUA | 3102-3122 | A-2282848.1 | 3714 | UACAAAAACCGGUACAAAUAAGA | 3100-3122 |
| AD-1223235.1 | A-2282849.1 | 3266 | UAUUUGUACCGGUUUUUGUAA | 3103-3123 | A-2282850.1 | 3715 | UUACAAAAACCGGUACAAAUAAG | 3101-3123 |
| AD-1223236.1 | A-2282851.1 | 3267 | AUUUGUACCGGUUUUUGUAUA | 3104-3124 | A-2282852.1 | 3716 | UAUACAAAAACCGGUACAAAUAA | 3102-3124 |
| AD-1223237.1 | A-2282853.1 | 3268 | UUUGUACCGGUUUUUGUAUAA | 3105-3125 | A-2282854.1 | 3717 | UUAUACAAAAACCGGUACAAAUA | 3103-3125 |
| AD-1223238.1 | A-2282855.1 | 3269 | UUGUACCGGUUUUUGUAUAUA | 3106-3126 | A-2282856.1 | 3718 | UAUAUACAAAAACCGGUACAAAU | 3104-3126 |
| AD-1223239.1 | A-2282857.1 | 3270 | UGUACCGGUUUUUGUAUAUAA | 3107-3127 | A-2282858.1 | 3719 | UUAUAUACAAAAACCGGUACAAA | 3105-3127 |
| AD-1223240.1 | A-2282859.1 | 3271 | GUACCGGUUUUUGUAUAUAAA | 3108-3128 | A-2282860.1 | 3720 | UUUAUAUACAAAAACCGGUACAA | 3106-3128 |
| AD-1223241.1 | A-2282861.1 | 3272 | UACCGGUUUUUGUAUAUAAAA | 3109-3129 | A-2282862.1 | 3721 | UUUUAUAUACAAAAACCGGUACA | 3107-3129 |
| AD-1223242.1 | A-2282863.1 | 3273 | ACCGGUUUUUGUAUAUAAAAA | 3110-3130 | A-2282864.1 | 3722 | UUUUUAUAUACAAAAACCGGUAC | 3108-3130 |
| AD-1223243.1 | A-2282865.1 | 3274 | AUUCAUGUUUCCAAUCUCUCA | 3129-3149 | A-2282866.1 | 3723 | UGAGAGAUUGGAAACAUGAAUUU | 3127-3149 |
| AD-1223244.1 | A-2282867.1 | 3275 | UUCAUGUUUCCAAUCUCUCUA | 3130-3150 | A-2282868.1 | 3724 | UAGAGAGAUUGGAAACAUGAAUU | 3128-3150 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1223245.1 | A-2282869.1 | 3276 | UCAUGUUUCCAAUCUCUCUCA | 3131-3151 | A-2282870.1 | 3725 | UGAGAGAGAUUGGAAACAUGAAU | 3129-3151 |
| AD-1223246.1 | A-2282871.1 | 3277 | CAUGUUUCCAAUCUCUCUCUA | 3132-3152 | A-2282872.1 | 3726 | UAGAGAGAGAUUGGAAACAUGAA | 3130-3152 |
| AD-1223247.1 | A-2282873.1 | 3278 | AUGUUUCCAAUCUCUCUCUCA | 3133-3153 | A-2282874.1 | 3727 | UGAGAGAGAGAUUGGAAACAUGA | 3131-3153 |
| AD-1223248.1 | A-2282875.1 | 3279 | UGUUUCCAAUCUCUCUCUCCA | 3134-3154 | A-2282876.1 | 3728 | UGGAGAGAGAGAUUGGAAACAUG | 3132-3154 |
| AD-1223249.1 | A-2282877.1 | 3280 | UUUCCAAUCUCUCUCUCCCUA | 3136-3156 | A-2282878.1 | 3729 | UAGGGAGAGAGAGAUUGGAAACA | 3134-3156 |
| AD-1223250.1 | A-2282879.1 | 3281 | UCCAAUCUCUCUCUCCCUGAA | 3138-3158 | A-2282880.1 | 3730 | UUCAGGGAGAGAGAGAUUGGAAA | 3136-3158 |
| AD-1223251.1 | A-2282881.1 | 3282 | CGGUGACAGUCACUAGCUUAA | 3159-3179 | A-2282882.1 | 3731 | UUAAGCUAGUGACUGUCACCGAU | 3157-3179 |
| AD-1223252.1 | A-2282883.1 | 3283 | GGUGACAGUCACUAGCUUAUA | 3160-3180 | A-2282884.1 | 3732 | UAUAAGCUAGUGACUGUCACCGA | 3158-3180 |
| AD-1223253.1 | A-2282885.1 | 3284 | AGUCACUAGCUUAUCUUGAAA | 3166-3186 | A-2282886.1 | 3733 | UUUCAAGAUAAGCUAGUGACUGU | 3164-3186 |
| AD-1223254.1 | A-2282887.1 | 3285 | GUCACUAGCUUAUCUUGAACA | 3167-3187 | A-2282888.1 | 3734 | UGUUCAAGAUAAGCUAGUGACUG | 3165-3187 |
| AD-1223255.1 | A-2282889.1 | 3286 | UCACUAGCUUAUCUUGAACAA | 3168-3188 | A-2282890.1 | 3735 | UUGUUCAAGAUAAGCUAGUGACU | 3166-3188 |
| AD-1223256.1 | A-2282891.1 | 3287 | ACUAGCUUAUCUUGAACAGAA | 3170-3190 | A-2282892.1 | 3736 | UUCUGUUCAAGAUAAGCUAGUGA | 3168-3190 |
| AD-1223257.1 | A-2282893.1 | 3288 | CUAGCUUAUCUUGAACAGAUA | 3171-3191 | A-2282894.1 | 3737 | UAUCUGUUCAAGAUAAGCUAGUG | 3169-3191 |
| AD-1223258.1 | A-2282895.1 | 3289 | UAGCUUAUCUUGAACAGAUAA | 3172-3192 | A-2282896.1 | 3738 | UUAUCUGUUCAAGAUAAGCUAGU | 3170-3192 |
| AD-1223259.1 | A-2282897.1 | 3290 | AGCUUAUCUUGAACAGAUAUA | 3173-3193 | A-2282898.1 | 3739 | UAUAUCUGUUCAAGAUAAGCUAG | 3171-3193 |
| AD-1223260.1 | A-2282899.1 | 3291 | GCUUAUCUUGAACAGAUAUUA | 3174-3194 | A-2282900.1 | 3740 | UAAUAUCUGUUCAAGAUAAGCUA | 3172-3194 |
| AD-1223261.1 | A-2282901.1 | 3292 | CAGCACACAUUCCUUUGAAAA | 3241-3261 | A-2282902.1 | 3741 | UUUUCAAAGGAAUGUGUGCUGGG | 3239-3261 |
| AD-1223262.1 | A-2282903.1 | 3293 | AGCACACAUUCCUUUGAAAUA | 3242-3262 | A-2282904.1 | 3742 | UAUUUCAAAGGAAUGUGUGCUGG | 3240-3262 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1223263.1 | A-2282905.1 | 3294 | GCACACAUUCCUUUGAAAUAA | 3243-3263 | A-2282906.1 | 3743 | UUAUUUCAAAGGAAUGUGUGCUG | 3241-3263 |
| AD-1223264.1 | A-2282907.1 | 3295 | CACACAUUCCUUUGAAAUAAA | 3244-3264 | A-2282908.1 | 3744 | UUUAUUUCAAAGGAAUGUGUGCU | 3242-3264 |
| AD-1223265.1 | A-2282909.1 | 3296 | CACAUUCCUUUGAAAUAAGGA | 3246-3266 | A-2282910.1 | 3745 | UCCUUAUUUCAAAGGAAUGUGUG | 3244-3266 |
| AD-1223266.1 | A-2282911.1 | 3297 | UCCUUUGAAAUAAGGUUUCAA | 3251-3271 | A-2282912.1 | 3746 | UUGAAACCUUAUUUCAAAGGAAU | 3249-3271 |
| AD-1223267.1 | A-2282913.1 | 3298 | CUUUGAAAUAAGGUUUCAAUA | 3253-3273 | A-2282914.1 | 3747 | UAUUGAAACCUUAUUUCAAAGGA | 3251-3273 |
| AD-1223268.1 | A-2282915.1 | 3299 | UUUGAAAUAAGGUUUCAAUAA | 3254-3274 | A-2282916.1 | 3748 | UUAUUGAAACCUUAUUUCAAAGG | 3252-3274 |
| AD-1223269.1 | A-2282917.1 | 3300 | AGGUUUCAAUAUACAUCUACA | 3263-3283 | A-2282918.1 | 3749 | UGUAGAUGUAUAUUGAAACCUUA | 3261-3283 |
| AD-1223270.1 | A-2282919.1 | 3301 | GGUUUCAAUAUACAUCUACAA | 3264-3284 | A-2282920.1 | 3750 | UUGUAGAUGUAUAUUGAAACCUU | 3262-3284 |
| AD-1223271.1 | A-2282921.1 | 3302 | GUUUCAAUAUACAUCUACAUA | 3265-3285 | A-2282922.1 | 3751 | UAUGUAGAUGUAUAUUGAAACCU | 3263-3285 |
| AD-1223272.1 | A-2282923.1 | 3303 | UUUCAAUAUACAUCUACAUAA | 3266-3286 | A-2282924.1 | 3752 | UUAUGUAGAUGUAUAUUGAAACC | 3264-3286 |
| AD-1223273.1 | A-2282925.1 | 3304 | UUCAAUAUACAUCUACAUACA | 3267-3287 | A-2282926.1 | 3753 | UGUAUGUAGAUGUAUAUUGAAAC | 3265-3287 |
| AD-1223274.1 | A-2282927.1 | 3305 | UAUUUGGCAACUUGUAUUUGA | 3295-3315 | A-2282928.1 | 3754 | UCAAAUACAAGUUGCCAAAUAUA | 3293-3315 |
| AD-1223275.1 | A-2282929.1 | 3306 | UUUGGCAACUUGUAUUUGUGA | 3297-3317 | A-2282930.1 | 3755 | UCACAAAUACAAGUUGCCAAAUA | 3295-3317 |
| AD-1223276.1 | A-2282931.1 | 3307 | UGGCAACUUGUAUUUGUGUGA | 3299-3319 | A-2282932.1 | 3756 | UCACACAAAUACAAGUUGCCAAA | 3297-3319 |
| AD-1223277.1 | A-2282933.1 | 3308 | GGCAACUUGUAUUUGUGUGUA | 3300-3320 | A-2282934.1 | 3757 | UACACACAAAUACAAGUUGCCAA | 3298-3320 |
| AD-1223278.1 | A-2282935.1 | 3309 | GCAACUUGUAUUUGUGUGUAA | 3301-3321 | A-2282936.1 | 3758 | UUACACACAAAUACAAGUUGCCA | 3299-3321 |
| AD-1223279.1 | A-2282937.1 | 3310 | CAACUUGUAUUUGUGUGUAUA | 3302-3322 | A-2282938.1 | 3759 | UAUACACACAAAUACAAGUUGCC | 3300-3322 |
| AD-1223280.1 | A-2282939.1 | 3311 | AACUUGUAUUUGUGUGUAUAA | 3303-3323 | A-2282940.1 | 3760 | UUAUACACACAAAUACAAGUUGC | 3301-3323 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Anti-sense Oligo Name | SEQ ID NO: (Anti-sense) | Antisense Sequence | mRNA Target Range |
|---|---|---|---|---|---|---|---|---|
| AD-1223281.1 | A-2282941.1 | 3312 | ACUUGUAUUUGUGUGUAUAUA | 3304-3324 | A-2282942.1 | 3761 | UAUAUACACACAAAUACAAGUUG | 3302-3324 |
| AD-1223282.1 | A-2282943.1 | 3313 | UUCUGAUAAAAUAGACAUUGA | 3354-3374 | A-2282944.1 | 3762 | UCAAUGUCUAUUUUAUCAGAAUC | 3352-3374 |
| AD-1223283.1 | A-2282945.1 | 3314 | UGAUAAAAUAGACAUUGCUAA | 3357-3377 | A-2282946.1 | 3763 | UUAGCAAUGUCUAUUUUAUCAGA | 3355-3377 |
| AD-1223284.1 | A-2282947.1 | 3315 | GAUAAAAUAGACAUUGCUAUA | 3358-3378 | A-2282948.1 | 3764 | UAUAGCAAUGUCUAUUUUAUCAG | 3356-3378 |
| AD-1223285.1 | A-2282949.1 | 3316 | UAAAAUAGACAUUGCUAUUCA | 3360-3380 | A-2282950.1 | 3765 | UGAAUAGCAAUGUCUAUUUUAUC | 3358-3380 |
| AD-1223286.1 | A-2282951.1 | 3317 | UAGACAUUGCUAUUCUGUUUA | 3365-3385 | A-2282952.1 | 3766 | UAAACAGAAUAGCAAUGUCUAUU | 3363-3385 |
| AD-1223287.1 | A-2282953.1 | 3318 | AGACAUUGCUAUUCUGUUUUA | 3366-3386 | A-2282954.1 | 3767 | UAAAACAGAAUAGCAAUGUCUAU | 3364-3386 |
| AD-1223288.1 | A-2282955.1 | 3319 | UCUACAUACUAAAUCUCUCUA | 3422-3442 | A-2282956.1 | 3768 | UAGAGAGAUUUAGUAUGUAGAAU | 3420-3442 |
| AD-1223289.1 | A-2282957.1 | 3320 | CUACAUACUAAAUCUCUCUCA | 3423-3443 | A-2282958.1 | 3769 | UGAGAGAGAUUUAGUAUGUAGAA | 3421-3443 |
| AD-1223290.1 | A-2282959.1 | 3321 | UACAUACUAAAUCUCUCUCCA | 3424-3444 | A-2282960.1 | 3770 | UGGAGAGAGAUUUAGUAUGUAGA | 3422-3444 |
| AD-1223291.1 | A-2282961.1 | 3322 | ACAUACUAAAUCUCUCUCCUA | 3425-3445 | A-2282962.1 | 3771 | UAGGAGAGAGAUUUAGUAUGUAG | 3423-3445 |
| AD-1223292.1 | A-2282963.1 | 3323 | CAUACUAAAUCUCUCUCCUUA | 3426-3446 | A-2282964.1 | 3772 | UAAGGAGAGAGAUUUAGUAUGUA | 3424-3446 |
| AD-1223293.1 | A-2282965.1 | 3324 | AUACUAAAUCUCUCUCCUUUA | 3427-3447 | A-2282966.1 | 3773 | UAAAGGAGAGAGAUUUAGUAUGU | 3425-3447 |
| AD-1223294.1 | A-2282967.1 | 3325 | UACUAAAUCUCUCUCCUUUUA | 3428-3448 | A-2282968.1 | 3774 | UAAAAGGAGAGAGAUUUAGUAUG | 3426-3448 |
| AD-1223295.1 | A-2282969.1 | 3326 | CAUUUAUUUAUUGGUGCUACA | 3468-3488 | A-2282970.1 | 3775 | UGUAGCACCAAUAAAUAAAUGAU | 3466-3488 |
| AD-1223296.1 | A-2282971.1 | 3327 | AUUUAUUUAUUGGUGCUACUA | 3469-3489 | A-2282972.1 | 3776 | UAGUAGCACCAAUAAAUAAAUGA | 3467-3489 |
| AD-1223297.1 | A-2282973.1 | 3328 | UUUAUUUAUUGGUGCUACUGA | 3470-3490 | A-2282974.1 | 3777 | UCAGUAGCACCAAUAAAUAAAUG | 3468-3490 |
| AD-1223298.1 | A-2282975.1 | 3329 | UUAUUUAUUGGUGCUACUGUA | 3471-3491 | A-2282976.1 | 3778 | UACAGUAGCACCAAUAAAUAAAU | 3469-3491 |

TABLE 8B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Antisense) | Antisense Sequence | mRNA Target Range |
|---|---|---|---|---|---|---|---|---|
| AD-1223299.1 | A-2282977.1 | 3330 | UAUUUAUUGGUGCUACUGUUA | 3472-3492 | A-2282978.1 | 3779 | UAACAGUAGCACCAAUAAAUAAA | 3470-3492 |
| AD-1223300.1 | A-2282979.1 | 3331 | AUUUAUUGGUGCUACUGUUUA | 3473-3493 | A-2282980.1 | 3780 | UAAACAGUAGCACCAAUAAAUAA | 3471-3493 |
| AD-1223301.1 | A-2282981.1 | 3332 | UUAUUGGUGCUACUGUUUAUA | 3475-3495 | A-2282982.1 | 3781 | UAUAAACAGUAGCACCAAUAAAU | 3473-3495 |
| AD-1223302.1 | A-2282983.1 | 3333 | AUUGGUGCUACUGUUUAUCCA | 3477-3497 | A-2282984.1 | 3782 | UGGAUAAACAGUAGCACCAAUAA | 3475-3497 |
| AD-1223303.1 | A-2282985.1 | 3334 | GAAAAGAUAUUAACAUCACGA | 3511-3531 | A-2282986.1 | 3783 | UCGUGAUGUUAAUAUCUUUUCCC | 3509-3531 |
| AD-1223304.1 | A-2282987.1 | 3335 | AACAUCACGUCUUUGUCUCUA | 3522-3542 | A-2282988.1 | 3784 | UAGAGACAAAGACGUGAUGUUAA | 3520-3542 |
| AD-1223305.1 | A-2282989.1 | 3336 | ACAUCACGUCUUUGUCUCUAA | 3523-3543 | A-2282990.1 | 3785 | UUAGAGACAAAGACGUGAUGUUA | 3521-3543 |
| AD-1223306.1 | A-2282991.1 | 3337 | GUCUUUGUCUCUAGUGCAGUA | 3530-3550 | A-2282992.1 | 3786 | UACUGCACUAGAGACAAAGACGU | 3528-3550 |
| AD-1223307.1 | A-2282993.1 | 3338 | UCUUUGUCUCUAGUGCAGUUA | 3531-3551 | A-2282994.1 | 3787 | UAACUGCACUAGAGACAAAGACG | 3529-3551 |
| AD-1223308.1 | A-2282995.1 | 3339 | CUUUGUCUCUAGUGCAGUUUA | 3532-3552 | A-2282996.1 | 3788 | UAAACUGCACUAGAGACAAAGAC | 3530-3552 |
| AD-1223309.1 | A-2282997.1 | 3340 | GAGAUAUUCCGUAGUACAUAA | 3555-3575 | A-2282998.1 | 3789 | UUAUGUACUACGGAAUAUCUCGA | 3553-3575 |
| AD-1223310.1 | A-2282999.1 | 3341 | AGAUAUUCCGUAGUACAUAUA | 3556-3576 | A-2283000.1 | 3790 | UAUAUGUACUACGGAAUAUCUCG | 3554-3576 |
| AD-1223311.1 | A-2283001.1 | 3342 | GAUAUUCCGUAGUACAUAUUA | 3557-3577 | A-2283002.1 | 3791 | UAAUAUGUACUACGGAAUAUCUC | 3555-3577 |
| AD-1223312.1 | A-2283003.1 | 3343 | CGACAAAGAAAUACAGAUAUA | 3590-3610 | A-2283004.1 | 3792 | UAUAUCUGUAUUUCUUUGUCGUU | 3588-3610 |
| AD-1223313.1 | A-2283005.1 | 3344 | GACAAAGAAAUACAGAUAUAA | 3591-3611 | A-2283006.1 | 3793 | UUAUAUCUGUAUUUCUUUGUCGU | 3589-3611 |
| AD-1223314.1 | A-2283007.1 | 3345 | ACAAAGAAAUACAGAUAUAUA | 3592-3612 | A-2283008.1 | 3794 | UAUAUAUCUGUAUUUCUUUGUCG | 3590-3612 |
| AD-1223315.1 | A-2283009.1 | 3346 | CAAAGAAAUACAGAUAUAUCA | 3593-3613 | A-2283010.1 | 3795 | UGAUAUAUCUGUAUUUCUUUGUC | 3591-3613 |

TABLE 10A

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1353514.1 | A-2521322.1 | 3796 | asasaag(Ahd)gadAadGuguuuuausasa | A-2521323.1 | 3886 | VPusdTsaudAadAacacdTudTcdTcuuuuscsu | AGAAAAGAGAAAGUGUUUUAUAU | 5149 |
| AD-1353484.1 | A-2521264.1 | 3797 | asasaag(Ahd)gaAfAfGfuguuuuausasa | A-2521265.1 | 3887 | VPusdTsaudAadAacacdTuUfcucuuuuscsu | AGAAAAGAGAAAGUGUUUUAUAU | 5150 |
| AD-1353454.1 | A-2521212.1 | 3798 | asasaag(Ahd)GfaAfAfGfuguuuuausasa | A-2282766.1 | 3888 | VPusUfsauaAfaacacuuUfcUfcuuuuscsu | AGAAAAGAGAAAGUGUUUUAUAU | 5151 |
| AD-1353468.1 | A-2521232.1 | 3799 | asasaga(Chd)ugAfUfAfcagaacgasusa | A-2521233.1 | 3889 | VPusdAsucdGudTcugudAuCfagucuuuscsc | GGAAAGACUGAUACAGAACGAUC | 5152 |
| AD-1353498.1 | A-2521292.1 | 3800 | asasaga(Chd)ugdAudAcagaacgasusa | A-1800369.1 | 3890 | VPusdAsucdGudTcugudAudCadGucuuuscsc | GGAAAGACUGAUACAGAACGAUC | 5153 |
| AD-1353438.1 | A-1700819.1 | 3801 | asasaga(Chd)UfgAfUfAfcagaacgasusa | A-2282346.1 | 3891 | VPusAfsucgUfucuguauCfaGfucuuuscsc | GGAAAGACUGAUACAGAACGAUC | 5154 |
| AD-1353515.1 | A-2521324.1 | 3802 | asasagagaadAgdTguuu(Uhd)auasusa | A-2521325.1 | 3892 | VPusdAsuadTadAaacadCudTudCucuuususc | GAAAAGAGAAAGUGUUUUAUAUA | 5155 |
| AD-1353485.1 | A-2521266.1 | 3803 | asasagagaaAfGfUfguuu(Uhd)auasusa | A-2521267.1 | 3893 | VPusdAsuadTadAaacadCuUfucucuuususc | GAAAAGAGAAAGUGUUUUAUAUA | 5156 |
| AD-1353455.1 | A-2521213.1 | 3804 | asasagagAfaAfGfUfguuu(Uhd)auasusa | A-2282768.1 | 3894 | VPusAfsuauAfaaacacuUfuCfucuuususc | GAAAAGAGAAAGUGUUUUAUAUA | 5157 |
| AD-1353513.1 | A-2521320.1 | 3805 | asascag(Uhd)gcdTadAuguuauugsgsa | A-2521321.1 | 3895 | VPusdCscadAudAacaudTadGcdAcuguusgsg | UUAACAGUGCUAAUGUUAUUGGU | 5158 |
| AD-1353483.1 | A-2521262.1 | 3806 | asascag(Uhd)gcUfAfAfuguuauugsgsa | A-2521263.1 | 3896 | VPusdCscadAudAacaudTaGfcacuguusgsg | UUAACAGUGCUAAUGUUAUUGGU | 5159 |
| AD-1353453.1 | A-1700832.1 | 3807 | asascag(Uhd)GfcUfAfAfuguuauugsgsa | A-2521211.1 | 3897 | VPusCfscaaUfaacauuaGfcAfcuguusgsg | UUAACAGUGCUAAUGUUAUUGGU | 5160 |
| AD-1353502.1 | A-2521298.1 | 3808 | asascga(Uhd)cgdAudAcagaaaccsasa | A-2521299.1 | 3898 | VPusdTsggdTu(U2p)cugudAudCgdAucguus | AGAACGAUCGAUACAGAAACCAC | 5161 |
| AD-1353472.1 | A-2521240.1 | 3809 | asascga(Uhd)cgAfUfAfcagaaaccsasa | A-2521241.1 | 3899 | VPusdTsggdTu(U2p)cugudAuCfgaucguuscs | AGAACGAUCGAUACAGAAACCAC | 5162 |
| AD-1353442.1 | A-2521195.1 | 3810 | asascga(Uhd)CfgAfUfAfcagaaaccsasa | A-2521196.1 | 3900 | VPusUfsggdTu(U2p)cuguauCfgAfucguuscsu | AGAACGAUCGAUACAGAAACCAC | 5163 |

TABLE 10A-continued

| Duplex Name | Sense Oligo Name | SEQ ID NO: (Sense) | Sense Sequence | Antisense Oligo Name | SEQ ID NO: (Antisense) | Antisense Sequence | mRNA Target Sequence | SEQ ID NO: (mRNA target) |
|---|---|---|---|---|---|---|---|---|
| Exemplary Human VEGF-A siRNA Modified Single Strands and Duplex Sequences | | | | | | | | |
| AD-1353499.1 | A-2483623.1 | 3811 | asasgac(Uhd)gadTadCaga acgauscsa | A-2521293.1 | 3901 | VPusdGsaudCg(U2p) ucugdTadTedAgucuus | GAAAGACUGAUA CAGAACGAUCG | 5164 |
| AD-1353469.1 | A-2521234.1 | 3812 | asasgac(Uhd)gaUfAfCfag aacgauscsa | A-2521235.1 | 3902 | VPusdGsaudCg(U2p) ucugdTaUfcagucuusus | GAAAGACUGAUA CAGAACGAUCG | 5165 |
| AD-1353439.1 | A-1700820.1 | 3813 | asasgac(Uhd)GfaUfAfCfa gaacgauscsa | A-2521191.1 | 3903 | VPusGfsaudCg(U2p)u cuguaUfcAfgucuusuc | GAAAGACUGAUA CAGAACGAUCG | 5166 |
| AD-1353516.1 | A-2521326.1 | 3814 | asasgag(Ahd)aadGudGuu uuauausasa | A-2521327.1 | 3904 | VPusdTsaudAudAaaa cdAcdTudTcucuusus u | AAAAGAGAAAGU GUUUUAUAUAC | 5167 |
| AD-1353486.1 | A-2521268.1 | 3815 | asasgag(Ahd)aaGfUfGfuu uuauausasa | A-2521269.1 | 3905 | VPusdTsaudAudAaaa cdAcUfuucucuusus u | AAAAGAGAAAGU GUUUUAUAUAC | 5168 |
| AD-1353456.1 | A-2521214.1 | 3816 | asasgag(Ahd)AfaGfUfGfu uuuauausasa | A-2282770.1 | 3906 | VPusUfsauaUfaaaacac UfuUfcucuusus u | AAAAGAGAAAGU GUUUUAUAUAC | 5169 |
| AD-1353509.1 | A-2521312.1 | 3817 | asasuuggaudTcdGccau (Uhd)uuasusa | A-2521313.1 | 3907 | VPusdAsuadAadAugg cdGadAudCcaauuscsc | GGAAUUGGAUUC GCCAUUUUAUU | 5170 |
| AD-1353479.1 | A-2521254.1 | 3818 | asasuuggauUfCfGfccau (Uhd)uuasusa | A-2521255.1 | 3908 | VPusdAsuadAadAugg cdGaAfuccaauuscsc | GGAAUUGGAUUC GCCAUUUUAUU | 5171 |
| AD-1353449.1 | A-2521206.1 | 3819 | asasuuggAfuUfCfGfccau (Uhd)uuasusa | A-2282454.1 | 3909 | VPusAfsuaaAfauggcg aAfuCfcaauuscsc | GGAAUUGGAUUC GCCAUUUUAUU | 5172 |
| AD-1353503.1 | A-2521300.1 | 3820 | ascsaga(Ahd)cadGudCcuu aauccsasa | A-2521301.1 | 3910 | VPusdTsggdAudTaag gdAcdTgdTucuguscsg | CGACAGAACAGUC CUUAAUCCAG | 5173 |
| AD-1353473.1 | A-2521242.1 | 3821 | ascsaga(Ahd)caGfUfCfcu uaauccsasa | A-2521243.1 | 3911 | VPusdTsggdAudTaag gdAcUfguucuguscsg | CGACAGAACAGUC CUUAAUCCAG | 5174 |
| AD-1353443.1 | A-2521197.1 | 3822 | ascsaga(Ahd)CfaGfUfCfc uuaauccsasa | A-2282402.1 | 3912 | VPusUfsggaUfuaagga cUfgUfucuguscsg | CGACAGAACAGUC CUUAAUCCAG | 5175 |
| AD-1353506.1 | A-2521306.1 | 3823 | ascsagu(Chd)cudTadAucc agaaascsa | A-2521307.1 | 3913 | VPusdGsuudTc(U2p)g gaudTadAgdGacugusu | GAACAGUCCUUAA UCCAGAAACC | 5176 |
| AD-1353476.1 | A-2521248.1 | 3824 | ascsagu(Chd)cuUfAfAfuc cagaaascsa | A-2521249.1 | 3914 | VPusdGsuudTc(U2p)g gaudTaAfggacugususc | GAACAGUCCUUAA UCCAGAAACC | 5177 |
| AD-1353446.1 | A-2521201.1 | 3825 | ascsagu(Chd)CfuUfAfAfu ccagaaascsa | A-2521202.1 | 3915 | VPusGfsuudTc(U2p)g gauuaAfgGfacugususc | GAACAGUCCUUAA UCCAGAAACC | 5178 |

TABLE 10A-continued

| Exemplary Human VEGF-A siRNA Modified Single Strands and Duplex Sequences | | | | | | | | |
|---|---|---|---|---|---|---|---|---|
| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
| AD-1353497.1 | A-2521290.1 | 3826 | ascscaggaadAgdAcuga (Uhd)acasgsa | A-2521291.1 | 3916 | VPusdCsugdTadTcag udCudTudCcuggusgsc | UCACCAGGAAAGA CUGAUACAGA | 5179 |
| AD-1353467.1 | A-2521230.1 | 3827 | ascscaggaaAfGfAfcuga (Uhd)acasgsa | A-2521231.1 | 3917 | VPusdCsugdTadTcag udCuUfuccuggusgsc | UCACCAGGAAAGA CUGAUACAGA | 5180 |
| AD-1353437.1 | A-2521189.1 | 3828 | ascscaggAfaAfGfAfcuga (Uhd)acasgsa | A-2521190.1 | 3918 | VPusCfsuguAfucaguc uUfuCfcuggusgsc | UCACCAGGAAAGA CUGAUACAGA | 5181 |
| AD-1353494.1 | A-2521284.1 | 3829 | ascscaugcadGadTuaug (Chd)ggasusa | A-2521285.1 | 3919 | VPusdAsucdCg(C2p)a uaadTcdTgdCauggusg | UCACCAUGCAGAU UAUGCGGAUC | 5182 |
| AD-1353464.1 | A-2521224.1 | 3830 | ascscaugcaGfAfUfuaug (Chd)ggasusa | A-2521225.1 | 3920 | VPusdAsucdCg(C2p)a uaadTcUfgcauggusgsc | UCACCAUGCAGAU UAUGCGGAUC | 5183 |
| AD-1353434.1 | A-2521183.1 | 3831 | ascscaugCfaGfAfUfuaug (Chd)ggasusa | A-2521184.1 | 3921 | VPusAfsucdCg(C2p)a uaaucUfgCfauggusgsc | UCACCAUGCAGAU UAUGCGGAUC | 5184 |
| AD-1353505.1 | A-2521304.1 | 3832 | asgsaac(Ahd)gudCcdTuaa uccagsasa | A-2521305.1 | 3922 | VPusdTscudGg(A2p)u uaadGgdAcdT guucusg | ACAGAACAGUCCU UAAUCCAGAA | 5185 |
| AD-1353475.1 | A-2521246.1 | 3833 | asgsaac(Ahd)guCfCfUfua auccagsasa | A-2521247.1 | 3923 | VPusdTscudGg(A2p)u uaadGgAfcuguucusgs | ACAGAACAGUCCU UAAUCCAGAA | 5186 |
| AD-1353445.1 | A-2521199.1 | 3834 | asgsaac(Ahd)GfuCfCfUfu aauccagsasa | A-2521200.1 | 3924 | VPusUfscudGg(A2p)u uaaggAfcUfguucusgsu | ACAGAACAGUCCU UAAUCCAGAA | 5187 |
| AD-1353518.1 | A-2521330.1 | 3835 | asgsaug(Uhd)audCudTuug cucucsusa | A-2521331.1 | 3925 | VPusdAsgadGa(G2p)c aaadAgdAudAcaucusc | UGAGAUGUAUCU UUUGCUCUCUC | 5188 |
| AD-1353490.1 | A-2521276.1 | 3836 | asgsaug(Uhd)auCfUfUfuu gcucucsusa | A-2521277.1 | 3926 | VPusdAsgadGa(G2p)c aaadAgAfuacaucuscsg | UGAGAUGUAUCU UUUGCUCUCUC | 5189 |
| AD-1353460.1 | A-2521217.1 | 3837 | asgsaug(Uhd)AfuCfUfUfu ugcucucsusa | A-2521218.1 | 3927 | VPusAfsgadGa(G2p)c aaaagAfuAfcaucuscsg | UGAGAUGUAUCU UUUGCUCUCUC | 5190 |
| AD-1353512.1 | A-2521318.1 | 3838 | asgsauu(Ahd)gadGadGuu uuauuuscsa | A-2521319.1 | 3928 | VPusdGsaadAudAaaa cdTcdTcdTaaucususc | GAAGAUUAGAGA GUUUUAUUUCU | 5191 |
| AD-1353482.1 | A-2521260.1 | 3839 | asgsauu(Ahd)gaGfAfGfuu uuauuuscsa | A-2521261.1 | 3929 | VPusdGsaadAudAaaa cdTcUfcuaaucususc | GAAGAUUAGAGA GUUUUAUUUCU | 5192 |
| AD-1353452.1 | A-2521210.1 | 3840 | asgsauu(Ahd)GfaGfAfGfu uuuauuuscsa | A-2282496.1 | 3930 | VPusGfsaaaUfaaaacuc UfcUfaaucususc | GAAGAUUAGAGA GUUUUAUUUCU | 5193 |

TABLE 10A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1353501.1 | A-2521296.1 | 3841 | asusacagaadCgdAucga (Uhd)acasgsa | A-2521297.1 | 3931 | VPusdCsugdTa(U2p)c gaudCgdTudCuguausc | UGAUACAGAACG AUCGAUACAGA | 5194 |
| AD-1353471.1 | A-2521238.1 | 3842 | asusacagaaCfGfAfucga (Uhd)acasgsa | A-2521239.1 | 3932 | VPusdCsugdTa(U2p)c gaudCgUfucuguauscs | UGAUACAGAACG AUCGAUACAGA | 5195 |
| AD-1353441.1 | A-2521193.1 | 3843 | asusacagAfaCfGfAfucga (Uhd)acasgsa | A-2521194.1 | 3933 | VPusCfsugdTa(U2p)c gaucgUfuCfuguauscsg | UGAUACAGAACG AUCGAUACAGA | 5196 |
| AD-1353495.1 | A-2521286.1 | 3844 | asusgcagaudTadTgcgg (Ahd)ucasasa | A-2521287.1 | 3934 | VPusdTsugdAu(C2p)c gcadTadAudCugcausg | CCAUGCAGAUUAU GCGGAUCAAA | 5197 |
| AD-1353465.1 | A-2521226.1 | 3845 | asusgcagauUfAfUfgcgg (Ahd)ucasasa | A-2521227.1 | 3935 | VPusdTsugdAu(C2p)c gcadTaAfucugcausgsg | CCAUGCAGAUUAU GCGGAUCAAA | 5198 |
| AD-1353435.1 | A-2521185.1 | 3846 | asusgcagAfuUfAfUfgcgg (Ahd)ucasasa | A-2521186.1 | 3936 | VPusUfsugdAu(C2p)c gcauaAfuCfugcausgsg | CCAUGCAGAUUAU GCGGAUCAAA | 5199 |
| AD-1353510.1 | A-2521314.1 | 3847 | asusugg(Ahd)uudCgdCca uuuuaususa | A-2521315.1 | 3937 | VPusdAsaudAadAaug gdCgdAadTccaaususc | GAAUUGGAUUCG CCAUUUUAUUU | 5200 |
| AD-1353480.1 | A-2521256.1 | 3848 | asusugg(Ahd)uuCfGfCfca uuuuaususa | A-2521257.1 | 3938 | VPusdAsaudAadAaug gdCgAfauccaaususc | GAAUUGGAUUCG CCAUUUUAUUU | 5201 |
| AD-1353450.1 | A-2521207.1 | 3849 | asusugg(Ahd)UfuCfGfCfc auuuuaususa | A-2282456.1 | 3939 | VPusAfsauaAfaauggc gAfaUfccaaususc | GAAUUGGAUUCG CCAUUUUAUUU | 5202 |
| AD-1353492.1 | A-2521280.1 | 3850 | csasaca(Uhd)cadCcdAugc agauusasa | A-2521281.1 | 3940 | VPusdTsaadTc(U2p)g caudGgdTgdAuguugs | UCCAACAUCACCA UGCAGAUUAU | 5203 |
| AD-1353462.1 | A-2521220.1 | 3851 | csasaca(Uhd)caCfCfAfugc agauusasa | A-2521221.1 | 3941 | VPusdTsaadTc(U2p)g caudGgUfgauguugsgs | UCCAACAUCACCA UGCAGAUUAU | 5204 |
| AD-1353432.1 | A-2521180.1 | 3852 | csasaca(Uhd)CfaCfCfAfu gcagauusasa | A-2521181.1 | 3942 | VPusUfsaadTc(U2p)g cauggUfgAfuguugsgsc | UCCAACAUCACCA UGCAGAUUAU | 5205 |
| AD-1353504.1 | A-2521302.1 | 3853 | csasgaa(Chd)agdTcdCuua auccasgsa | A-2521303.1 | 3943 | VPusdCsugdGa(U2p) uaagdGadCudGuucug | GACAGAACAGUCC UUAAUCCAGA | 5206 |
| AD-1353474.1 | A-2521244.1 | 3854 | csasgaa(Chd)agUfCfCfuu aauccasgsa | A-2521245.1 | 3944 | VPusdCsugdGa(U2p) uaagdGaCfuguucugsu | GACAGAACAGUCC UUAAUCCAGA | 5207 |
| AD-1353444.1 | A-1700826.1 | 3855 | csasgaa(Chd)AfgUfCfCfu uaauccasgsa | A-2521198.1 | 3945 | VPusCfsugdGa(U2p)u aaggaCfuGfuucugsusc | GACAGAACAGUCC UUAAUCCAGA | 5208 |

TABLE 10A-continued

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1353493.1 | A-2521282.1 | 3856 | csasuca(Chd)cadTgdCaga uuaugscsa | A-2521283.1 | 3946 | VPusdGscadTadAucu gdCadTgdGugaugsusu | AACAUCACCAUGC AGAUUAUGCG | 5209 |
| AD-1353463.1 | A-2521222.1 | 3857 | csasuca(Chd)caUfGfCfaga uuaugscsa | A-2521223.1 | 3947 | VPusdGscadTadAucu gdCaUfggugaugsusu | AACAUCACCAUGC AGAUUAUGCG | 5210 |
| AD-1353433.1 | A-2521182.1 | 3858 | csasuca(Chd)CfaUfGfCfa gauuaugscsa | A-2282286.1 | 3948 | VPusGfscauAfaucugc aUfgGfugaugsusu | AACAUCACCAUGC AGAUUAUGCG | 5211 |
| AD-1353508.1 | A-2521310.1 | 3859 | cscsucu(Uhd)ggdAadTugg auucgscsa | A-2521311.1 | 3949 | VPusdGscgdAadTcca adTudCcdAagaggsgsc | UCCCUCUUGGAAU UGGAUUCGCC | 5212 |
| AD-1353478.1 | A-2521252.1 | 3860 | cscsucu(Uhd)ggAfAfUfug gauucgscsa | A-2521253.1 | 3950 | VPusdGscgdAadTcca adTuCfcaagaggsgsc | UCCCUCUUGGAAU UGGAUUCGCC | 5213 |
| AD-1353448.1 | A-2521204.1 | 3861 | cscsucu(Uhd)GfgAfAfUfu ggauucgscsa | A-2521205.1 | 3951 | VPusGfscgaAfuccaau uCfcAfagaggsgsc | UCCCUCUUGGAAU UGGAUUCGCC | 5214 |
| AD-1353496.1 | A-2521288.1 | 3862 | csusacagcadCadAcaaa (Uhd)gugsasa | A-2521289.1 | 3952 | VPusdTscadCadTuug udTgdTgdCuguagsgsg | UCCUACAGCACAA CAAAUGUGAA | 5215 |
| AD-1353466.1 | A-2521228.1 | 3863 | csusacagcaCfAfAfcaaa (Uhd)gugsasa | A-2521229.1 | 3953 | VPusdTscadCadTuug udTgUfgcuguagsgsg | UCCUACAGCACAA CAAAUGUGAA | 5216 |
| AD-1353436.1 | A-2521187.1 | 3864 | csusacagCfaCfAfAfcaaa (Uhd)gugsasa | A-2521188.1 | 3954 | VPusUfscacAfuuuguu gUfgCfuguagsgsg | UCCUACAGCACAA CAAAUGUGAA | 5217 |
| AD-1353500.1 | A-2521294.1 | 3865 | csusgau(Ahd)cadGadAcga ucgausasa | A-2521295.1 | 3955 | VPusdTsaudCg(A2p)u cgudTcdTgdTaucagsu | GACUGAUACAGA ACGAUCGAUAC | 5218 |
| AD-1353470.1 | A-2521236.1 | 3866 | csusgau(Ahd)caGfAfAfcg aucgausasa | A-2521237.1 | 3956 | VPusdTsaudCg(A2p)u cgudTcUfguaucagsusc | GACUGAUACAGA ACGAUCGAUAC | 5219 |
| AD-1353440.1 | A-1700824.1 | 3867 | csusgau(Ahd)CfaGfAfAfc gaucgausasa | A-2521192.1 | 3957 | VPusUfsaudCg(A2p)u cguucUfgUfaucagsusc | GACUGAUACAGA ACGAUCGAUAC | 5220 |
| AD-1334067.3 | A-2483626.1 | 3868 | gsasaag(Uhd)gudTudTaua uacggsusa | A-1800443.1 | 3958 | VPusdAsccdGudAuau adAadAcdAcuuucsusc | GAGAAAGUGUUU UAUAUACGGUA | 5221 |
| AD-1353488.1 | A-2521272.1 | 3869 | gsasaag(Uhd)guUfUfUfau auacggsusa | A-2521273.1 | 3959 | VPusdAsccdGudAuau adAaAfcacuuucsusc | GAGAAAGUGUUU UAUAUACGGUA | 5222 |
| AD-1353458.1 | A-1700894.1 | 3870 | gsasaag(Uhd)GfuUfUfUfa uauacggsusa | A-2521215.1 | 3960 | VPusAfsccgUfauauaa aAfcAfcuuucsusc | GAGAAAGUGUUU UAUAUACGGUA | 5223 |

TABLE 10A-continued

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| Exemplary Human VEGF-A siRNA Modified Single Strands and Duplex Sequences | | | | | | | | |
| AD-1334065.3 | A-2483624.1 | 3871 | gsasgaa(Ahd)gudGudTuuauauacsgsa | A-1800396.1 | 3961 | VPusdCsgudAudAuaaadAcdAcdTuucucsusu | AAGAGAAAGUGUUUUAUAUACGG | 5224 |
| AD-1353487.1 | A-2521270.1 | 3872 | gsasgaa(Ahd)guGfUfUfuuauauacsgsa | A-2521271.1 | 3962 | VPusdCsgudAudAuaaadAcAfcuuucucsusu | AAGAGAAAGUGUUUUAUAUACGG | 5225 |
| AD-1353457.1 | A-1700845.1 | 3873 | gsasgaa(Ahd)GfuGfUfUfuuauauacsgsa | A-2282774.1 | 3963 | VPusCfsguaUfauaaaacAfcUfuucucsusu | AAGAGAAAGUGUUUUAUAUACGG | 5226 |
| AD-1353511.1 | A-2521316.1 | 3874 | gsasuucgccdAudTuuau(Uhd)uuuscsa | A-2521317.1 | 3964 | VPusdGsaadAadAuaaadAudGgdCgaaucscsg | UGGAUUCGCCAUUUUAUUUUUCU | 5227 |
| AD-1353481.1 | A-2521258.1 | 3875 | gsasuucgccAfUfUfuuau(Uhd)uuuscsa | A-2521259.1 | 3965 | VPusdGsaadAadAuaaadAuGfgcgaaucscsg | UGGAUUCGCCAUUUUAUUUUUCU | 5228 |
| AD-1353451.1 | A-2521208.1 | 3876 | gsasuucgCfcAfUfUfuuau(Uhd)uuuscsa | A-2521209.1 | 3966 | VPusGfsaaaAfauaaaauGfgCfgaaucscsg | UGGAUUCGCCAUUUUAUUUUUCU | 5229 |
| AD-1353507.1 | A-2521308.1 | 3877 | gsusccu(Uhd)aadTcdCagaaaccusgsa | A-2521309.1 | 3967 | VPusdCsagdGudTucugdGadTudAaggacsusg | CAGUCCUUAAUCCAGAAACCUGA | 5230 |
| AD-1353477.1 | A-2521250.1 | 3878 | gsusccu(Uhd)aaUfCfCfagaaaccusgsa | A-2521251.1 | 3968 | VPusdCsagdGudTucugdGaUfuaaggacsusg | CAGUCCUUAAUCCAGAAACCUGA | 5231 |
| AD-1353447.1 | A-2521203.1 | 3879 | gsusccu(Uhd)AfaUfCfCfagaaaccusgsa | A-2282416.1 | 3969 | VPusCfsaggUfuucuggaUfuAfaggacsusg | CAGUCCUUAAUCCAGAAACCUGA | 5232 |
| AD-1353517.1 | A-2521328.1 | 3880 | gsusguu(Uhd)uadTadTacgguacususa | A-2521329.1 | 3970 | VPusdAsagdTadCcguadTadTadAaacacsusu | AAGUGUUUUAUAUACGGUACUUA | 5233 |
| AD-1353489.1 | A-2521274.1 | 3881 | gsusguu(Uhd)uaUfAfUfacgguacususa | A-2521275.1 | 3971 | VPusdAsagdTadCcguadTaUfaaaacacsusu | AAGUGUUUUAUAUACGGUACUUA | 5234 |
| AD-1353459.1 | A-2521216.1 | 3882 | gsusguu(Uhd)UfaUfAfUfacgguacususa | A-2282784.1 | 3972 | VPusAfsaguAfccguauaUfaAfaacacsusu | AAGUGUUUUAUAUACGGUACUUA | 5235 |
| AD-1353519.1 | A-2521332.1 | 3883 | usasgac(Ahd)uudGcdTauucuguususa | A-2521333.1 | 3973 | VPusdAsaadCadGaauadGcdAadTgucuasusu | AAUAGACAUUGCUAUUCUGUUUU | 5236 |

TABLE 10A-continued

| Exemplary Human VEGF-A siRNA Modified Single Strands and Duplex Sequences | | | | | | | | |
|---|---|---|---|---|---|---|---|---|
| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
| AD-1353491.1 | A-2521278.1 | 3884 | usasgac(Ahd)uuGfCfUfauucuguususa | A-2521279.1 | 3974 | VPusdAsaadCadGaauadGcAfaugucuasusu | AAUAGACAUUGCUAUUCUGUUUU | 5237 |
| AD-1353461.1 | A-2521219.1 | 3885 | usasgac(Ahd)UfuGfCfUfauucuguususa | A-2282952.1.1 | 3975 | VPusAfsaacAfgaauagcAfaUfgucuasusu | AAUAGACAUUGCUAUUCUGUUUU | 5238 |

TABLE 10B

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-1353514.1 | A-2521322.1 | 3976 | AAAAGAGAAAGUGUUUUAUAA | 2940-2960 | A-2521323.1 | 4066 | UTAUAAAACACTUTCTCUUUUCU | 2938-2960 |
| AD-1353484.1 | A-2521264.1 | 3977 | AAAAGAGAAAGUGUUUUAUAA | 2940-2960 | A-2521265.1 | 4067 | UTAUAAAACACTUUCUCUUUUCU | 2938-2960 |
| AD-1353454.1 | A-2521212.1 | 3978 | AAAAGAGAAAGUGUUUUAUAA | 2940-2960 | A-2282766.1 | 4068 | UUAUAAAACACUUUCUCUUUUCU | 2938-2960 |
| AD-1353468.1 | A-2521232.1 | 3979 | AAAGACUGAUACAGAACGAUA | 1795-1815 | A-2521233.1 | 4069 | UAUCGUTCUGUAUCAGUCUUUCC | 1793-1815 |
| AD-1353498.1 | A-2521292.1 | 3980 | AAAGACUGAUACAGAACGAUA | 1795-1815 | A-1800369.1 | 4070 | UAUCGUTCUGUAUCAGUCUUUCC | 1793-1815 |
| AD-1353438.1 | A-1700819.1 | 3981 | AAAGACUGAUACAGAACGAUA | 1795-1815 | A-2282346.1 | 4071 | UAUCGUUCUGUAUCAGUCUUUCC | 1793-1815 |
| AD-1353515.1 | A-2521324.1 | 3982 | AAAGAGAAAGTGUUUUAUAUA | 2941-2961 | A-2521325.1 | 4072 | UAUATAAAACACUTUCUCUUUUC | 2939-2961 |
| AD-1353485.1 | A-2521266.1 | 3983 | AAAGAGAAAGUGUUUUAUAUA | 2941-2961 | A-2521267.1 | 4073 | UAUATAAAACACUUUCUCUUUUC | 2939-2961 |
| AD-1353455.1 | A-2521213.1 | 3984 | AAAGAGAAAGUGUUUUAUAUA | 2941-2961 | A-2282768.1 | 4074 | UAUAUAAAACACUUUCUCUUUUC | 2939-2961 |
| AD-1353513.1 | A-2521320.1 | 3985 | AACAGUGCTAAUGUUAUUGGA | 2178-2198 | A-2521321.1 | 4075 | UCCAAUAACAUTAGCACUGUUGG | 2176-2198 |
| AD-1353483.1 | A-2521262.1 | 3986 | AACAGUGCUAAUGUUAUUGGA | 2178-2198 | A-2521263.1 | 4076 | UCCAAUAACAUTAGCACUGUUGG | 2176-2198 |
| AD-1353453.1 | A-1700832.1 | 3987 | AACAGUGCUAAUGUUAUUGGA | 2178-2198 | A-2521211.1 | 4077 | UCCAAUAACAUUAGCACUGUUGG | 2176-2198 |
| AD-1353502.1 | A-2521298.1 | 3988 | AACGAUCGAUACAGAAACCAA | 1809-1829 | A-2521299.1 | 4078 | UTGGTUUCUGUAUCGAUCGUUCU | 1807-1829 |
| AD-1353472.1 | A-2521240.1 | 3989 | AACGAUCGAUACAGAAACCAA | 1809-1829 | A-2521241.1 | 4079 | UTGGUUUCUGUAUCGAUCGUUCU | 1807-1829 |
| AD-1353442.1 | A-2521195.1 | 3990 | AACGAUCGAUACAGAAACCAA | 1809-1829 | A-2521196.1 | 4080 | UUGGUUUCUGUAUCGAUCGUUCU | 1807-1829 |
| AD-1353499.1 | A-2483623.1 | 3991 | AAGACUGATACAGAACGAUCA | 1796-1816 | A-2521293.1 | 4081 | UGAUCGUUCUGTATCAGUCUUUC | 1794-1816 |
| AD-1353469.1 | A-2521234.1 | 3992 | AAGACUGAUACAGAACGAUCA | 1796-1816 | A-2521235.1 | 4082 | UGAUCGUUCUGTAUCAGUCUUUC | 1794-1816 |
| AD-1353439.1 | A-1700820.1 | 3993 | AAGACUGAUACAGAACGAUCA | 1796-1816 | A-2521191.1 | 4083 | UGAUCGUUCUGUAUCAGUCUUUC | 1794-1816 |
| AD-1353516.1 | A-2521326.1 | 3994 | AAGAGAAAGUGUUUUAUAUAA | 2942-2962 | A-2521327.1 | 4084 | UTAUAUAAAACACTUTCUCUUUU | 2940-2962 |
| AD-1353486.1 | A-2521268.1 | 3995 | AAGAGAAAGUGUUUUAUAUAA | 2942-2962 | A-2521269.1 | 4085 | UTAUAUAAAACACUUUCUCUUUU | 2940-2962 |
| AD-1353456.1 | A-2521214.1 | 3996 | AAGAGAAAGUGUUUUAUAUAA | 2942-2962 | A-2282770.1 | 4086 | UUAUAUAAAACACUUUCUCUUUU | 2940-2962 |
| AD-1353509.1 | A-2521312.1 | 3997 | AAUUGGAUTCGCCAUUUUAUA | 1987-2007 | A-2521313.1 | 4087 | UAUAAAAUGGCGAAUCCAAUUCC | 1985-2007 |
| AD-1353479.1 | A-2521254.1 | 3998 | AAUUGGAUUCGCCAUUUUAUA | 1987-2007 | A-2521255.1 | 4088 | UAUAAAAUGGCGAAUCCAAUUCC | 1985-2007 |
| AD-1353449.1 | A-2521206.1 | 3999 | AAUUGGAUUCGCCAUUUUAUA | 1987-2007 | A-2282454.1 | 4089 | UAUAAAAUGGCGAAUCCAAUUCC | 1985-2007 |

TABLE 10B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-1353503.1 | A-2521300.1 | 4000 | ACAGAACAGUCCUUAAUCCAA | 1857-1877 | A-2521301.1 | 4090 | UTGGAUTAAGGACTGTUCUGUCG | 1855-1877 |
| AD-1353473.1 | A-2521242.1 | 4001 | ACAGAACAGUCCUUAAUCCAA | 1857-1877 | A-2521243.1 | 4091 | UTGGAUTAAGGACUGUUCUGUCG | 1855-1877 |
| AD-1353443.1 | A-2521197.1 | 4002 | ACAGAACAGUCCUUAAUCCAA | 1857-1877 | A-2282402.1 | 4092 | UUGGAUUAAGGACUGUUCUGUCG | 1855-1877 |
| AD-1353506.1 | A-2521306.1 | 4003 | ACAGUCCUTAAUCCAGAAACA | 1862-1882 | A-2521307.1 | 4093 | UGUUTCUGGAUTAAGGACUGUUC | 1860-1882 |
| AD-1353476.1 | A-2521248.1 | 4004 | ACAGUCCUUAAUCCAGAAACA | 1862-1882 | A-2521249.1 | 4094 | UGUUTCUGGAUTAAGGACUGUUC | 1860-1882 |
| AD-1353446.1 | A-2521201.1 | 4005 | ACAGUCCUUAAUCCAGAAACA | 1862-1882 | A-2521202.1 | 4095 | UGUUUCUGGAUUAAGGACUGUUC | 1860-1882 |
| AD-1353497.1 | A-2521290.1 | 4006 | ACCAGGAAAGACUGAUACAGA | 1789-1809 | A-2521291.1 | 4096 | UCUGTATCAGUCUTUCCUGGUGC | 1787-1809 |
| AD-1353467.1 | A-2521230.1 | 4007 | ACCAGGAAAGACUGAUACAGA | 1789-1809 | A-2521231.1 | 4097 | UCUGTATCAGUCUUUCCUGGUGC | 1787-1809 |
| AD-1353437.1 | A-2521189.1 | 4008 | ACCAGGAAAGACUGAUACAGA | 1789-1809 | A-2521190.1 | 4098 | UCUGUAUCAGUCUUUCCUGGUGC | 1787-1809 |
| AD-1353494.1 | A-2521284.1 | 4009 | ACCAUGCAGATUAUGCGGAUA | 1345-1365 | A-2521285.1 | 4099 | UAUCCGCAUAATCTGCAUGGUGC | 1343-1365 |
| AD-1353464.1 | A-2521224.1 | 4010 | ACCAUGCAGAUUAUGCGGAUA | 1345-1365 | A-2521225.1 | 4100 | UAUCCGCAUAATCUGCAUGGUGC | 1343-1365 |
| AD-1353434.1 | A-2521183.1 | 4011 | ACCAUGCAGAUUAUGCGGAUA | 1345-1365 | A-2521184.1 | 4101 | UAUCCGCAUAAUCUGCAUGGUGC | 1343-1365 |
| AD-1353505.1 | A-2521304.1 | 4012 | AGAACAGUCCUTAAUCCAGAA | 1859-1879 | A-2521305.1 | 4102 | UTCUGGAUUAAGGACTGUUCUGU | 1857-1879 |
| AD-1353475.1 | A-2521246.1 | 4013 | AGAACAGUCCUUAAUCCAGAA | 1859-1879 | A-2521247.1 | 4103 | UTCUGGAUUAAGGACUGUUCUGU | 1857-1879 |
| AD-1353445.1 | A-2521199.1 | 4014 | AGAACAGUCCUUAAUCCAGAA | 1859-1879 | A-2521200.1 | 4104 | UUCUGGAUUAAGGACUGUUCUGU | 1857-1879 |
| AD-1353518.1 | A-2521330.1 | 4015 | AGAUGUAUCUTUUGCUCUCUA | 3073-3093 | A-2521331.1 | 4105 | UAGAGAGCAAAAGAUACAUCUCG | 3071-3093 |
| AD-1353490.1 | A-2521276.1 | 4016 | AGAUGUAUCUUUUGCUCUCUA | 3073-3093 | A-2521277.1 | 4106 | UAGAGAGCAAAAGAUACAUCUCG | 3071-3093 |
| AD-1353460.1 | A-2521217.1 | 4017 | AGAUGUAUCUUUUGCUCUCUA | 3073-3093 | A-2521218.1 | 4107 | UAGAGAGCAAAAGAUACAUCUCG | 3071-3093 |
| AD-1353512.1 | A-2521318.1 | 4018 | AGAUUAGAGAGUUUUAUUUCA | 2037-2057 | A-2521319.1 | 4108 | UGAAAUAAAACTCTCTAAUCUUC | 2035-2057 |
| AD-1353482.1 | A-2521260.1 | 4019 | AGAUUAGAGAGUUUUAUUUCA | 2037-2057 | A-2521261.1 | 4109 | UGAAAUAAAACTCUCUAAUCUUC | 2035-2057 |
| AD-1353452.1 | A-2521210.1 | 4020 | AGAUUAGAGAGUUUUAUUUCA | 2037-2057 | A-2282496.1 | 4110 | UGAAAUAAAACUCUCUAAUCUUC | 2035-2057 |
| AD-1353501.1 | A-2521296.1 | 4021 | AUACAGAACGAUCGAUACAGA | 1803-1823 | A-2521297.1 | 4111 | UCUGTAUCGAUCGTUCUGUAUCG | 1801-1823 |
| AD-1353471.1 | A-2521238.1 | 4022 | AUACAGAACGAUCGAUACAGA | 1803-1823 | A-2521239.1 | 4112 | UCUGTAUCGAUCGUUCUGUAUCG | 1801-1823 |
| AD-1353441.1 | A-2521193.1 | 4023 | AUACAGAACGAUCGAUACAGA | 1803-1823 | A-2521194.1 | 4113 | UCUGTAUCGAUCGUUCUGUAUCG | 1801-1823 |

TABLE 10B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-1353495.1 | A-2521286.1 | 4024 | AUGCAGAUTATGCGGAUCAAA | 1348-1368 | A-2521287.1 | 4114 | UTUGAUCCGCATAAUCUGCAUGG | 1346-1368 |
| AD-1353465.1 | A-2521226.1 | 4025 | AUGCAGAUUAUGCGGAUCAAA | 1348-1368 | A-2521227.1 | 4115 | UTUGAUCCGCATAAUCUGCAUGG | 1346-1368 |
| AD-1353435.1 | A-2521185.1 | 4026 | AUGCAGAUUAUGCGGAUCAAA | 1348-1368 | A-2521186.1 | 4116 | UUUGAUCCGCAUAAUCUGCAUGG | 1346-1368 |
| AD-1353510.1 | A-2521314.1 | 4027 | AUUGGAUUCGCCAUUUUAUUA | 1988-2008 | A-2521315.1 | 4117 | UAAUAAAAUGGCGAATCCAAUUC | 1986-2008 |
| AD-1353480.1 | A-2521256.1 | 4028 | AUUGGAUUCGCCAUUUUAUUA | 1988-2008 | A-2521257.1 | 4118 | UAAUAAAAUGGCGAAUCCAAUUC | 1986-2008 |
| AD-1353450.1 | A-2521207.1 | 4029 | AUUGGAUUCGCCAUUUUAUUA | 1988-2008 | A-2282456.1 | 4119 | UAAUAAAAUGGCGAAUCCAAUUC | 1986-2008 |
| AD-1353492.1 | A-2521280.1 | 4030 | CAACAUCACCAUGCAGAUUAA | 1338-1358 | A-2521281.1 | 4120 | UTAATCUGCAUGGTGAUGUUGGC | 1336-1358 |
| AD-1353462.1 | A-2521220.1 | 4031 | CAACAUCACCAUGCAGAUUAA | 1338-1358 | A-2521221.1 | 4121 | UTAATCUGCAUGGUGAUGUUGGC | 1336-1358 |
| AD-1353432.1 | A-2521180.1 | 4032 | CAACAUCACCAUGCAGAUUAA | 1338-1358 | A-2521181.1 | 4122 | UUAATCUGCAUGGUGAUGUUGGC | 1336-1358 |
| AD-1353504.1 | A-2521302.1 | 4033 | CAGAACAGTCCUUAAUCCAGA | 1858-1878 | A-2521303.1 | 4123 | UCUGGAUUAAGGACUGUUCUGUC | 1856-1878 |
| AD-1353474.1 | A-2521244.1 | 4034 | CAGAACAGUCCUUAAUCCAGA | 1858-1878 | A-2521245.1 | 4124 | UCUGGAUUAAGGACUGUUCUGUC | 1856-1878 |
| AD-1353444.1 | A-1700826.1 | 4035 | CAGAACAGUCCUUAAUCCAGA | 1858-1878 | A-2521198.1 | 4125 | UCUGGAUUAAGGACUGUUCUGUC | 1856-1878 |
| AD-1353493.1 | A-2521282.1 | 4036 | CAUCACCATGCAGAUUAUGCA | 1341-1361 | A-2521283.1 | 4126 | UGCATAAUCUGCATGGUGAUGUU | 1339-1361 |
| AD-1353463.1 | A-2521222.1 | 4037 | CAUCACCAUGCAGAUUAUGCA | 1341-1361 | A-2521223.1 | 4127 | UGCATAAUCUGCAUGGUGAUGUU | 1339-1361 |
| AD-1353433.1 | A-2521182.1 | 4038 | CAUCACCAUGCAGAUUAUGCA | 1341-1361 | A-2282286.1 | 4128 | UGCAUAAUCUGCAUGGUGAUGUU | 1339-1361 |
| AD-1353508.1 | A-2521310.1 | 4039 | CCUCUUGGAATUGGAUUCGCA | 1979-1999 | A-2521311.1 | 4129 | UGCGAATCCAATUCCAAGAGGGC | 1977-1999 |
| AD-1353478.1 | A-2521252.1 | 4040 | CCUCUUGGAAUUGGAUUCGCA | 1979-1999 | A-2521253.1 | 4130 | UGCGAATCCAAUUCCAAGAGGGC | 1977-1999 |
| AD-1353448.1 | A-2521204.1 | 4041 | CCUCUUGGAAUUGGAUUCGCA | 1979-1999 | A-2521205.1 | 4131 | UGCGAAUCCAAUUCCAAGAGGGC | 1977-1999 |
| AD-1353496.1 | A-2521288.1 | 4042 | CUACAGCACAACAAAUGUGAA | 1405-1425 | A-2521289.1 | 4132 | UTCACATUUGUTGTGCUGUAGGG | 1403-1425 |
| AD-1353466.1 | A-2521228.1 | 4043 | CUACAGCACAACAAAUGUGAA | 1405-1425 | A-2521229.1 | 4133 | UTCACATUUGUTGUGCUGUAGGG | 1403-1425 |
| AD-1353436.1 | A-2521187.1 | 4044 | CUACAGCACAACAAAUGUGAA | 1405-1425 | A-2521188.1 | 4134 | UUCACAUUUGUUGUGCUGUAGGG | 1403-1425 |
| AD-1353500.1 | A-2521294.1 | 4045 | CUGAUACAGAACGAUCGAUAA | 1800-1820 | A-2521295.1 | 4135 | UTAUCGAUCGUTCTGTAUCAGUC | 1798-1820 |
| AD-1353470.1 | A-2521236.1 | 4046 | CUGAUACAGAACGAUCGAUAA | 1800-1820 | A-2521237.1 | 4136 | UTAUCGAUCGUTCUGUAUCAGUC | 1798-1820 |
| AD-1353440.1 | A-1700824.1 | 4047 | CUGAUACAGAACGAUCGAUAA | 1800-1820 | A-2521192.1 | 4137 | UUAUCGAUCGUUCUGUAUCAGUC | 1798-1820 |

TABLE 10B-continued

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-1334067.3 | A-2483626.1 | 4048 | GAAAGUGUTUTAUAUACGGUA | 2946-2966 | A-1800443.1 | 4138 | UACCGUAUAUAAAACACUUUCUC | 2944-2966 |
| AD-1353488.1 | A-2521272.1 | 4049 | GAAAGUGUUUUAUAUACGGUA | 2946-2966 | A-2521273.1 | 4139 | UACCGUAUAUAAAACACUUUCUC | 2944-2966 |
| AD-1353458.1 | A-1700894.1 | 4050 | GAAAGUGUUUUAUAUACGGUA | 2946-2966 | A-2521215.1 | 4140 | UACCGUAUAUAAAACACUUUCUC | 2944-2966 |
| AD-1334065.3 | A-2483624.1 | 4051 | GAGAAAGUGUTUUAUAUACGA | 2944-2964 | A-1800396.1 | 4141 | UCGUAUAUAAAACACTUUCUCUU | 2942-2964 |
| AD-1353487.1 | A-2521270.1 | 4052 | GAGAAAGUGUUUUAUAUACGA | 2944-2964 | A-2521271.1 | 4142 | UCGUAUAUAAAACACUUUCUCUU | 2942-2964 |
| AD-1353457.1 | A-1700845.1 | 4053 | GAGAAAGUGUUUUAUAUACGA | 2944-2964 | A-2282774.1 | 4143 | UCGUAUAUAAAACACUUUCUCUU | 2942-2964 |
| AD-1353511.1 | A-2521316.1 | 4054 | GAUUCGCCAUTUUAUUUUUCA | 1992-2012 | A-2521317.1 | 4144 | UGAAAAAUAAAAUGGCGAAUCCG | 1990-2012 |
| AD-1353481.1 | A-2521258.1 | 4055 | GAUUCGCCAUUUUAUUUUUCA | 1992-2012 | A-2521259.1 | 4145 | UGAAAAAUAAAAUGGCGAAUCCG | 1990-2012 |
| AD-1353451.1 | A-2521208.1 | 4056 | GAUUCGCCAUUUUAUUUUUCA | 1992-2012 | A-2521209.1 | 4146 | UGAAAAAUAAAAUGGCGAAUCCG | 1990-2012 |
| AD-1353507.1 | A-2521308.1 | 4057 | GUCCUUAATCCAGAAACCUGA | 1865-1885 | A-2521309.1 | 4147 | UCAGGUTUCUGGATUAAGGACUG | 1863-1885 |
| AD-1353477.1 | A-2521250.1 | 4058 | GUCCUUAAUCCAGAAACCUGA | 1865-1885 | A-2521251.1 | 4148 | UCAGGUTUCUGGAUUAAGGACUG | 1863-1885 |
| AD-1353447.1 | A-2521203.1 | 4059 | GUCCUUAAUCCAGAAACCUGA | 1865-1885 | A-2282416.1 | 4149 | UCAGGUUUCUGGAUUAAGGACUG | 1863-1885 |
| AD-1353517.1 | A-2521328.1 | 4060 | GUGUUUUATATACGGUACUUA | 2950-2970 | A-2521329.1 | 4150 | UAAGTACCGUATATAAAACACUU | 2948-2970 |
| AD-1353489.1 | A-2521274.1 | 4061 | GUGUUUUAUAUACGGUACUUA | 2950-2970 | A-2521275.1 | 4151 | UAAGTACCGUAUAUAAAACACUU | 2948-2970 |
| AD-1353459.1 | A-2521216.1 | 4062 | GUGUUUUAUAUACGGUACUUA | 2950-2970 | A-2282784.1 | 4152 | UAAGUACCGUAUAUAAAACACUU | 2948-2970 |
| AD-1353519.1 | A-2521332.1 | 4063 | UAGACAUUGCTAUUCUGUUUA | 3365-3385 | A-2521333.1 | 4153 | UAAACAGAAUAGCAATGUCUAUU | 3363-3385 |
| AD-1353491.1 | A-2521278.1 | 4064 | UAGACAUUGCUAUUCUGUUUA | 3365-3385 | A-2521279.1 | 4154 | UAAACAGAAUAGCAAUGUCUAUU | 3363-3385 |
| AD-1353461.1 | A-2521219.1 | 4065 | UAGACAUUGCUAUUCUGUUUA | 3365-3385 | A-2282952.1 | 4155 | UAAACAGAAUAGCAAUGUCUAUU | 3363-3385 |

TABLE 18A

Exemplary Human VEGF-A siRNA Modified Single Strands and Duplex Sequences

| Duplex Name | Sense Oligo Name | SEQ ID NO: (Sense) | Sense Sequence | Anti-sense Oligo Name | SEQ ID NO: (Anti-sense) | Antisense Sequence | mRNA Target Sequence | SEQ ID NO: (mRNA target) |
|---|---|---|---|---|---|---|---|---|
| AD-1020574 | A-1110770.1 | 4164 | csgsaca(Ghd)AfaCfAfGf uccuuaauscsa | A-1701268.1 | 4176 | VPusGfsauua(Agn)ggac ugUfuCfugucgsasu | AUCGACAGAACA GUCCUUAAUCC | 4188 |
| AD-901094 | A-1700826.1 | 4165 | csasgaa(Chd)AfgUfCfCf uuaauccasgsa | A-1068918.1 | 4177 | VPusCfsuggAfuUfAfag gaCfuGfuucugsusc | GACAGAACAGUC CUUAAUCCAGA | 4189 |
| AD-1020575 | A-1700826.1 | 4166 | csasgaa(Chd)AfgUfCfCf uuaauccasgsa | A-1701270.1 | 4178 | VPusCfsugga(Tgn)uaag gaCfuGfuucugsusc | GACAGAACAGUC CUUAAUCCAGA | 4190 |
| AD-901100 | A-1700832.1 | 4167 | asascag(Uhd)GfcUfAfAf uguuauugsgsa | A-1069342.1 | 4179 | VPusCfscaaUfaAfCfauu aGfcAfcuguusasa | UUAACAGUGCUA AUGUUAUUGGU | 4191 |
| AD-901101 | A-1700833.1 | 4168 | asgsugc(Uhd)AfaUfGfUf uauuggugsusa | A-1069348.1 | 4180 | VPusAfscacCfaAfUfaac aUfuAfgcacusgsu | ACAGUGCUAAUG UUAUUGGUGUC | 4192 |
| AD-901113 | A-1700845.1 | 4169 | gsasgaa(Ahd)GfuGfUfUf uuauauacsgsa | A-1070290.1 | 4181 | VPusCfsguaUfaUfAfaaa cAfcUfuucucsusu | AAGAGAAAGUGU UUUAUAUACGG | 4193 |
| AD-901123 | A-1700855.1 | 4170 | asasaau(Ahd)GfaCfAfUf ugcuauucsusa | A-1070790.1 | 4182 | VPusAfsgaaUfaGfCfaau gUfcUfauuuusasu | AUAAAAUAGACA UUGCUAUUCUG | 4194 |
| AD-901124 | A-1700856.1 | 4171 | asasaua(Ghd)AfcAfUfUf gcuauucusgsa | A-1070792.1 | 4183 | VPusCfsagaAfuAfGfcaa uGfuCfuauuusua | UAAAAUAGACAU UGCUAUUCUGU | 4195 |
| AD-901158 | A-1700894.1 | 4172 | gsasaag(Uhd)GfuUfUfUf auauacggsusa | A-1070294.1 | 4184 | VPusAfsccgUfaUfAfuaa aAfcAfcuuucsusc | GAGAAAGUGUUU UAUAUACGGUA | 4196 |
| AD-901159 | A-1700895.1 | 4173 | gsusuuu(Ahd)UfaUfAfCf gguacuuasusa | A-1070306.1 | 4185 | VPusAfsuaaGfuAfCfcgu aUfaUfaaaacsasc | GUGUUUUAUAUA CGGUACUUAUU | 4197 |
| AD-1020573 | A-1890520.1 | 4174 | asgsugc(Uhd)aadTgdTua uuggugsusa | A-1800384.1 | 4186 | VPusdAscadCcdAauaad CadTudAgcacusgsu | ACAGUGCUAAUG UUAUUGGUGUC | 4198 |
| AD-1023143 | A-1895607.1 | 4175 | asasaau(Ahd)gadCadTug cuauucsusa | A-1800407.1 | 4187 | VPusdAsgadAudAgcaad TgdTcdT auuuus asu | AUAAAAUAGACA UUGCUAUUCUG | 4199 |

TABLE 18B

Exemplary Human VEGF-A siRNA Unmodified Single Strands and Duplex Sequences

| Duplex Name | Sense Oligo Name | SEQ ID NO: (Sense) | Sense Sequence | mRNA Target Range | Antisense Oligo Name | SEQ ID NO: (Anti-sense) | Antisense Sequence | mRNA Target Range |
|---|---|---|---|---|---|---|---|---|
| AD-1020574 | A-1110770.1 | 4200 | CGACAGAACAGUCCUUAAUCA | 1855-1875 | A-1701268.1 | 4212 | UGAUUAAGGACUGUUCUGUCGAU | 1853-1875 |
| AD-901094 | A-1700826.1 | 4201 | CAGAACAGUCCUUAAUCCAGA | 1858-1878 | A-1068918.1 | 4213 | UCUGGAUUAAGGACUGUUCUGUC | 1856-1878 |
| AD-1020575 | A-1700826.1 | 4202 | CAGAACAGUCCUUAAUCCAGA | 1858-1878 | A-1701270.1 | 4214 | UCUGGATUAAGGACUGUUCUGUC | 1856-1878 |
| AD-901100 | A-1700832.1 | 4203 | AACAGUGCUAAUGUUAUUGGA | 2178-2198 | A-1069342.1 | 4215 | UCCAAUAACAUUAGCACUGUUAA | 2176-2198 |
| AD-901101 | A-1700833.1 | 4204 | AGUGCUAAUGUUAUUGGUGUA | 2181-2201 | A-1069348.1 | 4216 | UACACCAAUAACAUUAGCACUGU | 2179-2201 |
| AD-901113 | A-1700845.1 | 4205 | GAGAAAGUGUUUUAUAUACGA | 2944-2964 | A-1070290.1 | 4217 | UCGUAUAUAAAACACUUUCUCUU | 2942-2964 |
| AD-901123 | A-1700855.1 | 4206 | AAAAUAGACAUUGCUAUUCUA | 3361-3381 | A-1070790.1 | 4218 | UAGAAUAGCAAUGUCUAUUUUAU | 3359-3381 |
| AD-901124 | A-1700856.1 | 4207 | AAAUAGACAUUGCUAUUCUGA | 3362-3382 | A-1070792.1 | 4219 | UCAGAAUAGCAAUGUCUAUUUUA | 3360-3382 |
| AD-901158 | A-1700894.1 | 4208 | GAAAGUGUUUUAUAUACGGUA | 2946-2966 | A-1070294.1 | 4220 | UACCGUAUAUAAAACACUUUCUC | 2944-2966 |
| AD-901159 | A-1700895.1 | 4209 | GUUUUAUAUACGGUACUUAUA | 2952-2972 | A-1070306.1 | 4221 | UAUAAGUACCGUAUAUAAAACAC | 2950-2972 |
| AD-1020573 | A-1890520.1 | 4210 | AGUGCUAATGUUAUUGGUGUA | 2181-2201 | A-1800384.1 | 4222 | UACACCAAUAACATUAGCACUGU | 2179-2201 |
| AD-1023143 | A-1895607.1 | 4211 | AAAAUAGACATUGCUAUUCUA | 3361-3381 | A-1800407.1 | 4223 | UAGAAUAGCAATGTCTAUUUUAU | 3359-3381 |

Example 2. In Vitro Screening of VEGF-A siRNA

Experimental Methods

Cell Culture and Transfections:

Cos 7 Cell Transfections

Cos-7 (ATCC) were transfected by adding 5 μl of 1 ng/μl psiCHECK2 vector (Blue Heron Biotechnology) containing either Cynomolgus monkey (XM_005552887) or mouse (NM_001025250), 4.9 μl of Opti-MEM, 0.1 μl of Lipofectamine 2000 (Invitrogen, Carlsbad Calif. cat #11668-019), and 5 μl of siRNA duplexes per well into a 384-well plate. Following a 15-minute incubation at room temperature, thirty-five μl of Dulbecco's Modified Eagle Medium (ThermoFisher) containing ~$5\times10^3$ cells were then added to the siRNA-transfection mixture. Cells were incubated for 48 hours followed by Firefly (transfection control) and *Renilla* (fused to target sequence) luciferase measurements. Experiments were performed at 10 nM, 1 nM, and 0.1 nM.

APRE-19 Cell, hTERT REP-1, and Primary Human Hepatocyte Cell Transfections

ARPE-19 cells, hTERT RPE-1, or primary human hepatocyte cells (ATCC) were transfected by adding 4.9 μl of Opti-MEM plus 0.1 μl of RNAiMAX per well (Invitrogen, Carlsbad Calif. cat #13778-150) to 5 μl of siRNA duplexes per well, with 4 replicates of each siRNA duplex, into a 384-well plate, and incubated at room temperature for 15 minutes. Forty μl of DMEM:F12 Medium (ThermoFisher) containing ~$5\times10^3$ cells were then added to the siRNA-transfection mixture. Cells were incubated for 24 hours prior to RNA purification. Experiments were performed at 50 nM, 10 nM, 1 nM, and 0.1 nM.

Free Uptake Transfection:

Cryopreserved primary human hepatocytes were thawed at 37° C. in a water bath immediately prior to usage and re-suspended at $0.26\times10^6$ cells/mL in InVitroGRO CP (plating) medium (Celsis In Vitro Technologies, catalog number Z99029). During transfections, cells were plated onto a BD BioCoat 96 well collagen plate (BD, 356407) at 25,000 cells per well and incubated at 37° C. in an atmosphere of 5% CO2. Free Uptake experiments were performed by adding 10 μL of siRNA duplexes in PBS per well into a 96 well plate. Ninety μL of complete growth media containing appropriate cell number for the cell was then added to the siRNA. Cells were incubated for 24 hours prior to RNA purification. Single dose experiments were performed at 500 nM, 100 nM, 10 nM, and 1 nM final duplex.

Total RNA Isolation Using DYNABEADS mRNA Isolation Kit:

RNA was isolated using an automated protocol on a BioTek-EL406 platform using DYNABEADs (Invitrogen, cat #61012). Briefly, 70 μl of Lysis/Binding Buffer and 10 μl of lysis buffer containing 3 μl of magnetic beads were added to the plate with cells. Plates were incubated on an electromagnetic shaker for 10 minutes at room temperature and then magnetic beads were captured and the supernatant was removed. Bead-bound RNA was then washed 2 times with 150 μl Wash Buffer A and once with Wash Buffer B. Beads were then washed with 150 μl Elution Buffer, re-captured and supernatant removed.

cDNA Synthesis Using ABI High Capacity cDNA Reverse Transcription Kit (Applied Biosystems, Foster City, Calif., Cat #4368813):

Ten μl of a master mix containing 1 μl 10× Buffer, 0.4 μl 25×dNTPs, 1 μl 10× Random primers, 0.5 μl Reverse Transcriptase, 0.5 μl RNase inhibitor and 6.6 μl of H2O per reaction was added to RNA isolated above. Plates were sealed, mixed, and incubated on an electromagnetic shaker for 10 minutes at room temperature, followed by 2 h 37° C.

Real Time PCR:

Two μl of cDNA and 50 Lightcycler 480 probe master mix (Roche Cat #04887301001) were added to either 0.5 μl of Human GAPDH TaqMan Probe (4326317E) and 0.5 μl VEGFA Human probe (Hs00900055_m1, Thermo) per well in a 384 well plates (Roche cat #04887301001). Real time PCR was done in a LightCycler480 Real Time PCR system (Roche). Each duplex was tested at least two times and data were normalized to cells transfected with a non-targeting control siRNA. To calculate relative fold change, real time data were analyzed using the ΔΔCt method and normalized to assays performed with cells transfected with a non-targeting control siRNA.

Results

The results of the multi-dose screen in human retinal pigment epithelial cells (ARPE-19) and human hTERT-immortalized retinal pigment epithelial cells (hTERT RPE-1) with three sets of exemplary human VEGF-A siRNAs are shown in Table 6A (correspond to siRNAs in Table 2A and Table 2B), Table 6B (correspond to siRNAs in Table 3A and Table 3B), and 6C (correspond to siRNAs in Table 4A and Table 4B). The multi-dose experiments were performed at 50 nM, 10 nM, 1 nM, and 0.1 nM final duplex concentrations and the data are expressed as percent message remaining relative to non-targeting control. Of the exemplary siRNA duplexes evaluated, 28 achieved a knockdown of VEGF-A of >90%, 108 achieved a knockdown of VEGF-A of ≥60%, and 229 achieved a knockdown of VEGF-A of ≥30% in in ARPE-19 cells when administered at the 10 nM concentration.

TABLE 6A

VEGF-A endogenous in vitro multi-dose screen with one set of exemplary human VEGF-A siRNAs

| | ARPE-19 | | | | | | | | hTERT RPE-1 | | | | | | | |
|---|---|---|---|---|---|---|---|---|---|---|---|---|---|---|---|---|
| Sample_Name | 50 nM | StDev | 10 nM | StDev | 1 nM | StDev | 0.1 nM | StDev | 50 nM | StDev | 10 nM | StDev | 1 nM | StDev | 0.1 nM | StDev |
| AD-901349.1 | 29.9 | 4.1 | 24.7 | 3.0 | 34.0 | 3.0 | 54.3 | 5.7 | 26.5 | 7.9 | 26.0 | 1.7 | 64.1 | 11.3 | 94.0 | 17.7 |
| AD-901376.1 | 28.3 | 4.6 | 25.4 | 7.6 | 35.7 | 8.8 | 50.3 | 14.1 | 15.1 | 2.7 | 20.9 | 4.1 | 37.6 | 8.3 | 46.9 | 4.6 |
| AD-901356.1 | 30.6 | 2.9 | 27.9 | 2.8 | 36.5 | 2.5 | 60.3 | 7.6 | 21.0 | 3.5 | 25.3 | 9.7 | 39.3 | 8.9 | 91.6 | 12.5 |
| AD-901355.1 | 42.0 | 2.2 | 28.7 | 3.7 | 39.6 | 0.2 | 65.7 | 11.5 | 26.9 | 2.3 | 27.4 | 9.6 | 44.8 | 4.0 | 92.6 | 22.9 |
| AD-901407.1 | 27.8 | 11.7 | 30.9 | 4.0 | 55.4 | 6.2 | 106.1 | 19.2 | 39.0 | 7.9 | 41.1 | 12.4 | 69.5 | 10.9 | 87.5 | 21.1 |
| AD-901367.1 | 39.0 | 4.8 | 31.5 | 3.7 | 38.6 | 7.1 | 50.4 | 2.2 | 31.0 | 6.3 | 39.3 | 5.5 | 38.1 | 5.2 | 77.0 | 13.4 |
| AD-901352.1 | 42.7 | 1.8 | 34.6 | 6.1 | 48.5 | 6.6 | 57.4 | 4.9 | 27.1 | 7.7 | 28.9 | 4.5 | 51.6 | 10.4 | 76.8 | 15.3 |
| AD-901348.1 | 44.5 | 7.3 | 35.0 | 7.2 | 40.6 | 4.7 | 62.4 | 9.1 | 35.4 | 6.8 | 23.0 | 4.2 | 50.0 | 18.5 | 97.9 | 21.6 |
| AD-901354.1 | 45.0 | 3.6 | 35.9 | 7.1 | 40.9 | 2.1 | 61.2 | 4.0 | 34.1 | 8.9 | 27.0 | 6.2 | 34.7 | 8.7 | 81.9 | 18.7 |
| AD-901353.1 | 50.8 | 5.9 | 37.6 | 8.6 | 29.8 | 4.7 | 52.4 | 2.4 | 36.1 | 6.5 | 21.5 | 4.3 | 40.4 | 8.7 | 98.2 | 11.7 |
| AD-901375.1 | 44.5 | 7.1 | 40.2 | 2.0 | 43.0 | 6.6 | 60.0 | 12.2 | 30.5 | 1.8 | 30.4 | 3.3 | 46.9 | 24.4 | 61.3 | 4.9 |
| AD-901345.1 | 53.1 | 6.0 | 42.9 | 9.0 | 74.3 | 13.7 | 73.0 | 16.3 | 74.8 | 12.7 | 62.2 | 18.1 | 61.7 | 9.5 | 85.2 | 14.5 |
| AD-901357.1 | 39.8 | 11.7 | 42.9 | 1.1 | 54.2 | 3.3 | 78.1 | 14.9 | 37.2 | 7.4 | 42.3 | 15.4 | 43.2 | 2.9 | 97.9 | 19.8 |
| AD-901334.1 | 55.7 | 4.7 | 43.4 | 7.2 | 77.4 | 9.8 | 76.7 | 6.0 | 74.9 | 18.4 | 47.9 | 12.8 | 73.3 | 17.2 | 85.9 | 8.5 |
| AD-901313.1 | 32.9 | 3.6 | 44.2 | 9.8 | 77.8 | 17.5 | 64.1 | 7.0 | 39.7 | 12.8 | 47.9 | 5.8 | 101.3 | 4.5 | 69.6 | 18.2 |
| AD-901344.1 | 71.9 | 5.4 | 46.9 | 6.7 | 78.6 | 16.2 | 59.4 | 9.0 | 75.8 | 6.0 | 72.9 | 21.0 | 62.0 | 13.2 | 78.4 | 7.8 |
| AD-901366.1 | 56.1 | 9.1 | 47.2 | 7.4 | 61.9 | 5.7 | 69.1 | 6.6 | 42.5 | 11.3 | 49.6 | 12.8 | 58.3 | 14.2 | 97.4 | 18.8 |
| AD-901337.1 | 70.7 | 7.9 | 47.7 | 9.4 | 101.6 | 21.1 | 82.6 | 9.4 | 91.8 | 17.2 | 64.0 | 25.7 | 80.8 | 21.3 | 86.4 | 7.4 |
| AD-901335.1 | 58.7 | 9.2 | 48.0 | 7.7 | 109.6 | 32.9 | 84.5 | 9.8 | 75.6 | 4.6 | 62.1 | 15.5 | 72.2 | 19.6 | 92.4 | 18.7 |
| AD-901398.1 | 51.6 | 2.2 | 48.0 | 8.3 | 63.3 | 5.6 | 91.1 | 11.3 | 39.6 | 8.2 | 55.7 | 9.8 | 71.8 | 10.1 | 56.2 | 8.4 |
| AD-901314.1 | 43.1 | 10.7 | 48.7 | 10.8 | 94.3 | 25.4 | 99.6 | 15.1 | 49.9 | 6.0 | 50.9 | 10.9 | 67.9 | 15.4 | 100.9 | 31.8 |
| AD-901386.1 | 51.7 | 6.0 | 49.5 | 2.7 | 82.7 | 59.5 | 75.9 | 21.6 | 62.6 | 20.0 | 42.9 | 8.8 | 55.4 | 20.7 | 45.8 | 8.9 |
| AD-901336.1 | 67.6 | 5.1 | 51.4 | 12.8 | 88.0 | 14.9 | 74.3 | 9.5 | 88.1 | 10.2 | 51.7 | 16.0 | 77.8 | 19.7 | 85.0 | 16.0 |
| AD-901310.1 | 40.9 | 8.2 | 53.0 | 5.6 | 88.6 | 18.3 | 82.0 | 5.8 | 46.8 | 7.6 | 52.4 | 10.7 | 71.9 | 11.7 | 76.1 | 7.3 |
| AD-901321.1 | 41.4 | 7.4 | 53.1 | 13.3 | 87.7 | 15.2 | 67.0 | 16.0 | 36.4 | 8.2 | 40.2 | 4.3 | 87.2 | 13.0 | 89.2 | 8.0 |
| AD-901382.1 | 57.5 | 4.2 | 53.7 | 3.0 | 62.8 | 4.5 | 90.1 | 19.4 | 41.0 | 12.4 | 37.9 | 9.3 | 68.2 | 10.5 | 63.9 | 9.5 |
| AD-901384.1 | 49.7 | 6.8 | 53.8 | 12.8 | 54.0 | 12.3 | 87.8 | 38.9 | 43.5 | 5.7 | 52.6 | 5.1 | 60.1 | 9.4 | 56.1 | 12.1 |
| AD-901339.1 | 80.3 | 16.6 | 54.0 | 7.4 | 76.7 | 11.8 | 74.7 | 3.5 | 96.3 | 18.7 | 68.3 | 12.5 | 68.9 | 13.3 | 89.7 | 11.8 |
| AD-901363.1 | 68.5 | 11.9 | 55.2 | 9.3 | 54.3 | 4.3 | 71.2 | 8.6 | 52.2 | 5.7 | 54.8 | 12.0 | 45.5 | 1.5 | 86.0 | 15.8 |
| AD-901325.1 | 71.6 | 2.4 | 55.6 | 7.1 | 111.4 | 11.4 | 95.5 | 4.4 | 77.5 | 15.7 | 69.8 | 10.8 | 88.4 | 10.0 | 96.8 | 6.0 |
| AD-901350.1 | 60.4 | 9.5 | 56.5 | 8.4 | 66.9 | 6.6 | 73.3 | 3.1 | 50.7 | 6.7 | 45.6 | 3.9 | 85.0 | 8.9 | 92.4 | 12.9 |
| AD-901365.1 | 68.6 | 5.1 | 56.5 | 6.6 | 64.8 | 7.6 | 79.6 | 12.3 | 48.9 | 18.5 | 52.3 | 13.3 | 56.8 | 16.7 | 96.1 | 8.8 |
| AD-901306.1 | 55.1 | 12.5 | 57.7 | 5.8 | 96.6 | 17.2 | 97.3 | 24.5 | 66.5 | 10.5 | 74.7 | 16.8 | 75.6 | 9.7 | 108.6 | 25.5 |
| AD-901361.1 | 50.8 | 6.9 | 58.5 | 18.8 | 45.6 | 3.1 | 68.6 | 10.3 | 44.9 | 4.3 | 36.2 | 9.9 | 57.7 | 6.5 | 95.4 | 14.9 |
| AD-901320.1 | 52.3 | 11.4 | 60.0 | 5.7 | 94.3 | 23.4 | 69.8 | 3.8 | 48.1 | 19.3 | 48.3 | 3.8 | 68.9 | 13.2 | 84.4 | 18.8 |
| AD-901405.1 | 64.5 | 3.4 | 60.5 | 9.8 | 80.4 | 7.5 | 83.6 | 15.4 | 63.1 | 9.2 | 72.3 | 21.9 | 74.6 | 9.3 | 55.6 | 6.4 |
| AD-901338.1 | 52.7 | 5.1 | 61.7 | 4.1 | 82.0 | 12.2 | 86.9 | 13.2 | 73.4 | 8.4 | 60.8 | 20.1 | 58.8 | 9.8 | 103.1 | 16.6 |
| AD-901383.1 | 62.0 | 8.9 | 62.2 | 7.7 | 78.2 | 11.8 | 92.7 | 14.8 | 57.0 | 9.8 | 62.6 | 11.9 | 75.1 | 16.6 | 75.2 | 7.0 |
| AD-901333.1 | 82.0 | 7.2 | 62.5 | 12.2 | 94.1 | 17.3 | 85.2 | 6.9 | 92.2 | 5.4 | 66.8 | 12.1 | 79.2 | 15.9 | 70.5 | 37.8 |
| AD-901330.1 | 75.7 | 8.7 | 63.0 | 9.7 | 96.4 | 6.3 | 104.5 | 23.5 | 90.8 | 8.4 | 63.2 | 16.4 | 82.5 | 16.6 | 109.3 | 30.1 |
| AD-901360.1 | 61.4 | 8.8 | 64.0 | 10.3 | 59.9 | 6.5 | 90.6 | 32.4 | 77.5 | 3.7 | 63.7 | 6.4 | 64.1 | 14.7 | 95.1 | 14.9 |
| AD-901358.1 | 67.4 | 11.4 | 65.3 | 5.4 | 71.0 | 3.6 | 82.3 | 6.7 | 58.5 | 5.3 | 49.5 | 6.5 | 62.8 | 4.6 | 94.4 | 11.9 |
| AD-901406.1 | 67.6 | 7.4 | 65.6 | 7.7 | 77.2 | 6.7 | 93.5 | 2.0 | 63.3 | 13.4 | 65.2 | 5.7 | 69.4 | 9.5 | 86.9 | 30.3 |
| AD-901326.1 | 78.8 | 14.8 | 65.8 | 16.8 | 120.8 | 26.0 | 88.1 | 8.0 | 85.9 | 5.7 | 69.6 | 11.8 | 88.6 | 15.2 | 98.3 | 14.6 |
| AD-901377.1 | 47.2 | 7.3 | 65.8 | 11.4 | 57.5 | 12.7 | 68.0 | 22.8 | 42.8 | 6.2 | 47.4 | 6.3 | 54.8 | 10.2 | 63.4 | 15.1 |
| AD-901351.1 | 69.4 | 9.6 | 66.9 | 10.1 | 82.5 | 6.8 | 85.7 | 5.3 | 73.9 | 8.0 | 56.8 | 13.1 | 81.2 | 30.7 | 97.6 | 36.5 |

TABLE 6A-continued

VEGF-A endogenous in vitro multi-dose screen with one set of exemplary human VEGF-A siRNAs

| | ARPE-19 | | | | | | | | hTERT RPE-1 | | | | | | | |
|---|---|---|---|---|---|---|---|---|---|---|---|---|---|---|---|---|
| Sample_Name | 50 nM | StDev | 10 nM | StDev | 1 nM | StDev | 0.1 nM | StDev | 50 nM | StDev | 10 nM | StDev | 1 nM | StDev | 0.1 nM | StDev |
| AD-901415.1 | 77.8 | 13.7 | 68.1 | 18.4 | 78.6 | 14.7 | 119.6 | 45.3 | 85.6 | 6.4 | 57.2 | 10.5 | 83.8 | 7.7 | 78.5 | 19.4 |
| AD-901342.1 | 87.4 | 20.2 | 70.1 | 10.3 | 113.4 | 21.8 | 79.3 | 12.1 | 90.5 | 27.6 | 56.2 | 11.2 | 80.2 | 21.4 | 91.5 | 14.4 |
| AD-901420.1 | 61.1 | 7.0 | 71.0 | 5.7 | 75.3 | 4.0 | 107.9 | 37.3 | 52.4 | 2.8 | 43.5 | 7.9 | 67.8 | 13.7 | 80.8 | 8.9 |
| AD-901312.1 | 62.1 | 10.7 | 71.2 | 8.0 | 102.4 | 22.9 | 76.5 | 2.4 | 75.1 | 7.7 | 60.1 | 15.4 | 100.2 | 30.7 | 73.8 | 17.5 |
| AD-901340.1 | 88.8 | 12.8 | 71.6 | 10.3 | 100.4 | 19.9 | 93.3 | 12.4 | 94.1 | 31.9 | 69.3 | 11.0 | 87.6 | 24.7 | 100.6 | 10.9 |
| AD-901392.1 | 49.7 | 9.0 | 71.6 | 13.2 | 69.0 | 4.0 | 81.0 | 47.1 | 41.3 | 2.9 | 61.4 | 10.0 | 77.7 | 12.1 | 74.3 | 5.4 |
| AD-901327.1 | 72.4 | 15.6 | 71.8 | 8.7 | 114.4 | 13.3 | 80.6 | 2.7 | 89.8 | 13.6 | 75.7 | 12.3 | 82.7 | 23.2 | 92.0 | 8.8 |
| AD-901328.1 | 77.7 | 13.0 | 72.6 | 6.3 | 104.1 | 10.6 | 76.9 | 7.7 | 87.2 | 16.3 | 70.5 | 4.1 | 89.5 | 8.4 | 86.4 | 10.7 |
| AD-901370.1 | 65.9 | 6.5 | 72.9 | 7.8 | 79.9 | 6.7 | 70.6 | 4.4 | 67.8 | 9.5 | 81.6 | 5.6 | 70.3 | 16.6 | 52.8 | 35.3 |
| AD-901399.1 | 63.2 | 10.4 | 72.9 | 7.8 | 79.3 | 5.9 | 98.0 | 11.8 | 52.6 | 4.9 | 78.5 | 18.2 | 62.3 | 12.7 | 68.9 | 7.0 |
| AD-901359.1 | 83.7 | 13.3 | 73.4 | 12.1 | 66.6 | 8.8 | 69.4 | 7.1 | 80.2 | 20.5 | 63.3 | 20.6 | 70.5 | 6.9 | 90.7 | 19.1 |
| AD-901373.1 | 81.5 | 10.9 | 73.4 | 4.6 | 73.5 | 2.4 | 69.8 | 8.7 | 52.1 | 11.0 | 61.9 | 17.9 | 60.7 | 10.9 | 56.7 | 12.5 |
| AD-901332.1 | 79.6 | 17.9 | 73.7 | 4.9 | 123.3 | 17.1 | 93.6 | 6.1 | 95.2 | 13.6 | 56.4 | 15.2 | 96.5 | 7.9 | 89.0 | 14.4 |
| AD-901311.1 | 53.7 | 10.4 | 74.5 | 9.5 | 98.0 | 27.9 | 72.0 | 4.0 | 67.5 | 16.0 | 69.0 | 9.2 | 64.6 | 10.3 | 73.9 | 3.3 |
| AD-901423.1 | 61.8 | 10.6 | 74.5 | 9.5 | 72.3 | 8.7 | 104.0 | 24.4 | 48.8 | 3.6 | 56.4 | 10.5 | 68.3 | 12.8 | 73.5 | 8.2 |
| AD-901374.1 | 92.4 | 18.4 | 74.5 | 9.6 | 86.9 | 12.5 | 71.0 | 14.7 | 90.5 | 13.9 | 52.7 | 13.4 | 81.5 | 12.0 | 61.3 | 12.7 |
| AD-901319.1 | 73.3 | 19.5 | 75.1 | 6.3 | 126.0 | 19.4 | 77.4 | 7.6 | 88.5 | 16.0 | 81.3 | 7.2 | 64.0 | 20.9 | 93.5 | 33.9 |
| AD-901341.1 | 88.8 | 12.2 | 75.5 | 8.1 | 107.3 | 10.6 | 79.2 | 5.8 | 77.2 | 20.8 | 86.1 | 24.0 | 96.8 | 15.9 | 93.0 | 10.6 |
| AD-901422.1 | 51.3 | 3.2 | 75.8 | 5.2 | 55.6 | 5.8 | 95.6 | 25.5 | 40.2 | 4.1 | 39.9 | 9.4 | 61.8 | 15.0 | 76.2 | 19.9 |
| AD-901385.1 | 67.7 | 13.9 | 75.8 | 16.1 | 86.8 | 10.9 | 93.1 | 21.7 | 72.9 | 11.6 | 72.2 | 14.5 | 76.4 | 13.2 | 65.1 | 10.3 |
| AD-901391.1 | 72.0 | 11.9 | 76.2 | 8.8 | 82.3 | 12.0 | 76.8 | 22.5 | 71.6 | 14.7 | 63.4 | 16.7 | 81.2 | 6.6 | 85.9 | 13.3 |
| AD-901329.1 | 72.5 | 10.6 | 76.3 | 11.1 | 107.1 | 12.2 | 79.8 | 9.2 | 98.2 | 17.4 | 75.5 | 10.9 | 100.5 | 15.9 | 93.9 | 6.9 |
| AD-901331.1 | 101.1 | 11.5 | 77.9 | 13.7 | 120.0 | 24.9 | 84.0 | 10.0 | 126.3 | 25.1 | 76.3 | 19.3 | 82.2 | 6.1 | 79.0 | 22.0 |
| AD-901368.1 | 73.7 | 9.1 | 79.5 | 11.1 | 82.4 | 5.5 | 90.1 | 31.1 | 98.3 | 21.8 | 97.4 | 7.8 | 64.4 | 19.9 | 85.4 | 4.9 |
| AD-901364.1 | 82.5 | 10.9 | 79.5 | 16.7 | 75.7 | 8.9 | 81.4 | 2.6 | 65.8 | 7.1 | 65.3 | 18.7 | 48.4 | 7.4 | 90.9 | 5.5 |
| AD-901389.1 | 69.1 | 10.2 | 80.3 | 6.1 | 80.4 | 9.2 | 87.2 | 22.8 | 50.7 | 2.4 | 55.9 | 6.4 | 82.8 | 21.5 | 59.0 | 16.1 |
| AD-901421.1 | 54.9 | 7.1 | 80.9 | 6.9 | 63.4 | 9.2 | 96.5 | 25.7 | 50.4 | 9.2 | 37.8 | 3.8 | 70.9 | 15.3 | 61.1 | 11.7 |
| AD-901380.1 | 85.6 | 16.8 | 81.0 | 6.5 | 60.9 | 9.0 | 83.7 | 9.2 | 74.9 | 12.3 | 77.7 | 6.6 | 54.5 | 11.3 | 75.8 | 19.3 |
| AD-901343.1 | 102.8 | 17.6 | 81.8 | 13.7 | 127.7 | 32.4 | 99.8 | 11.8 | 133.1 | 18.9 | 81.7 | 20.5 | 93.1 | 6.4 | 81.8 | 13.4 |
| AD-901317.1 | 89.8 | 12.2 | 81.8 | 4.8 | 131.2 | 51.1 | 90.6 | 5.2 | 120.7 | 22.3 | 86.4 | 4.5 | 69.7 | 11.0 | 76.7 | 7.1 |
| AD-901424.1 | 62.9 | 4.8 | 82.2 | 14.8 | 64.9 | 10.2 | 86.0 | 8.1 | 68.7 | 13.3 | 63.1 | 22.6 | 76.5 | 15.9 | 71.8 | 24.4 |
| AD-901431.1 | 84.8 | 11.4 | 82.9 | 20.5 | 75.7 | 10.5 | 96.4 | 29.5 | 79.4 | 15.9 | 88.8 | 25.2 | 85.1 | 8.9 | 80.8 | 21.7 |
| AD-901378.1 | 71.4 | 5.4 | 82.9 | 5.5 | 77.3 | 8.5 | 80.6 | 9.3 | 56.8 | 14.3 | 40.8 | 13.4 | 82.0 | 24.4 | 78.9 | 14.1 |
| AD-901434.1 | 70.3 | 11.3 | 83.8 | 8.4 | 59.4 | 1.3 | 92.1 | 11.3 | 62.6 | 8.3 | 72.7 | 17.5 | 69.9 | 12.0 | 82.0 | 11.3 |
| AD-901412.1 | 83.4 | 15.9 | 84.5 | 32.2 | 94.4 | 4.4 | 81.6 | 19.4 | 82.3 | 3.9 | 50.8 | 5.2 | 85.6 | 21.9 | 74.5 | 8.0 |
| AD-901426.1 | 96.7 | 7.7 | 85.1 | 13.5 | 68.2 | 7.2 | 104.4 | 9.3 | 92.5 | 15.3 | 61.5 | 4.0 | 56.0 | 7.0 | 80.4 | 15.0 |
| AD-901322.1 | 74.9 | 14.5 | 85.5 | 12.4 | 118.1 | 15.9 | 117.4 | 22.0 | 107.2 | 20.0 | 92.5 | 15.9 | 98.9 | 16.0 | 107.3 | 8.5 |
| AD-901381.1 | 92.6 | 10.5 | 85.7 | 4.9 | 93.9 | 10.2 | 90.8 | 17.0 | 72.5 | 15.0 | 74.0 | 16.8 | 85.0 | 21.6 | 71.5 | 16.1 |
| AD-901324.1 | 93.0 | 10.1 | 87.3 | 14.3 | 142.1 | 25.2 | 92.9 | 5.5 | 133.9 | 8.1 | 94.9 | 11.1 | 94.3 | 9.2 | 91.4 | 4.7 |
| AD-901347.1 | 84.2 | 11.6 | 87.7 | 9.5 | 101.8 | 19.4 | 83.9 | 4.4 | 96.1 | 10.3 | 84.6 | 25.5 | 105.8 | 6.4 | 96.3 | 13.4 |
| AD-901379.1 | 81.1 | 5.9 | 87.8 | 6.2 | 72.1 | 6.9 | 80.4 | 6.7 | 79.3 | 7.6 | 59.9 | 15.5 | 82.5 | 18.4 | 59.1 | 18.7 |
| AD-901428.1 | 71.8 | 4.4 | 88.2 | 18.3 | 74.5 | 8.0 | 93.0 | 16.6 | 89.7 | 13.0 | 52.5 | 12.6 | 65.9 | 17.7 | 76.7 | 13.3 |
| AD-901371.1 | 75.5 | 7.5 | 88.2 | 15.6 | 77.3 | 5.7 | 82.5 | 5.9 | 71.7 | 8.5 | 56.8 | 12.0 | 68.6 | 10.7 | 71.2 | 20.0 |
| AD-901408.1 | 74.4 | 14.1 | 88.8 | 30.8 | 91.5 | 5.1 | 85.5 | 11.2 | 75.4 | 14.5 | 57.2 | 15.1 | 97.4 | 21.5 | 76.5 | 13.3 |
| AD-901417.1 | 94.8 | 14.8 | 89.2 | 14.0 | 101.7 | 5.9 | 117.2 | 33.3 | 85.4 | 23.1 | 76.9 | 12.4 | 92.6 | 6.8 | 76.2 | 21.6 |
| AD-901400.1 | 82.9 | 10.1 | 89.7 | 8.6 | 97.9 | 11.3 | 97.7 | 22.9 | 97.5 | 12.8 | 101.9 | 12.3 | 98.8 | 13.0 | 65.3 | 17.5 |
| AD-901323.1 | 74.6 | 14.8 | 90.4 | 12.0 | 130.1 | 25.7 | 86.8 | 3.3 | 101.8 | 5.7 | 93.7 | 18.2 | 80.4 | 12.4 | 96.3 | 20.5 |
| AD-901316.1 | 91.0 | 18.0 | 90.8 | 8.3 | 139.5 | 42.5 | 96.3 | 3.1 | 99.6 | 17.7 | 93.6 | 8.8 | 80.1 | 28.4 | 96.5 | 18.2 |
| AD-901315.1 | 86.7 | 14.1 | 90.8 | 6.4 | 130.0 | 40.3 | 92.6 | 4.0 | 125.3 | 13.0 | 107.4 | 11.9 | 72.7 | 22.2 | 97.5 | 7.6 |
| AD-901395.1 | 77.9 | 11.7 | 90.9 | 5.9 | 80.0 | 4.0 | 86.9 | 20.7 | 65.9 | 13.2 | 63.8 | 10.5 | 87.3 | 8.0 | 74.9 | 19.2 |
| AD-901318.1 | 78.6 | 6.2 | 92.1 | 11.8 | 131.0 | 50.7 | 90.2 | 11.5 | 112.5 | 21.6 | 91.5 | 12.2 | 73.0 | 12.4 | 83.6 | 15.4 |
| AD-901390.1 | 75.3 | 12.2 | 93.3 | 5.9 | 95.8 | 9.4 | 96.1 | 23.2 | 47.0 | 6.9 | 66.4 | 7.4 | 71.5 | 4.7 | 64.3 | 14.3 |
| AD-901387.1 | 91.5 | 9.4 | 94.9 | 6.0 | 100.0 | 18.9 | 93.5 | 10.9 | 131.7 | 17.8 | 89.3 | 10.7 | 89.1 | 17.7 | 69.4 | 13.4 |
| AD-901307.1 | 66.0 | 13.3 | 95.4 | 11.1 | 105.1 | 21.0 | 90.1 | 4.9 | 119.0 | 15.4 | 100.5 | 12.7 | 74.3 | 28.2 | 105.8 | 10.9 |
| AD-901410.1 | 91.1 | 15.6 | 96.5 | 28.2 | 104.3 | 15.4 | 91.4 | 7.4 | 93.9 | 9.4 | 55.3 | 10.6 | 98.9 | 32.4 | 79.6 | 13.4 |
| AD-901433.1 | 86.9 | 4.6 | 96.9 | 18.9 | 74.6 | 2.3 | 98.2 | 8.3 | 81.1 | 19.2 | 58.0 | 15.9 | 81.0 | 12.6 | 73.6 | 12.0 |
| AD-901308.1 | 67.0 | 5.1 | 97.7 | 18.4 | 136.0 | 31.1 | 89.2 | 5.3 | 116.8 | 18.1 | 109.3 | 4.6 | 99.4 | 12.4 | 80.8 | 8.5 |
| AD-901414.1 | 88.8 | 12.1 | 98.1 | 31.3 | 94.5 | 2.6 | 94.0 | 16.9 | 88.5 | 4.8 | 64.8 | 17.5 | 70.2 | 8.3 | 82.3 | 11.3 |
| AD-901309.1 | 67.5 | 6.9 | 98.7 | 12.4 | 124.9 | 29.1 | 91.8 | 3.9 | 111.9 | 21.4 | 84.7 | 12.8 | 97.9 | 16.1 | 88.3 | 18.1 |
| AD-901362.1 | 75.1 | 11.6 | 99.1 | 22.7 | 91.0 | 7.1 | 91.6 | 12.6 | 93.3 | 9.1 | 99.8 | 38.1 | 69.3 | 19.5 | 92.9 | 13.0 |
| AD-901397.1 | 86.1 | 9.0 | 99.3 | 8.7 | 94.9 | 5.6 | 88.4 | 19.5 | 99.2 | 14.2 | 119.6 | 15.6 | 83.0 | 11.1 | 67.2 | 17.1 |
| AD-901419.1 | 74.3 | 12.2 | 100.1 | 11.9 | 80.7 | 8.0 | 116.8 | 34.6 | 74.5 | 14.5 | 49.9 | 4.4 | 89.7 | 14.6 | 72.7 | 12.1 |
| AD-901413.1 | 92.5 | 12.3 | 101.4 | 37.9 | 97.6 | 3.4 | 96.1 | 18.3 | 77.1 | 5.9 | 59.3 | 11.9 | 75.0 | 18.1 | 67.4 | 2.0 |
| AD-901401.1 | 95.3 | 6.8 | 101.8 | 10.4 | 116.3 | 16.9 | 98.8 | 24.7 | 138.0 | 19.8 | 97.0 | 15.7 | 102.4 | 24.1 | 81.1 | 10.2 |
| AD-901411.1 | 83.9 | 8.7 | 102.6 | 36.0 | 93.3 | 8.6 | 105.0 | 4.3 | 79.2 | 14.1 | 55.2 | 8.4 | 80.4 | 7.4 | 75.1 | 28.5 |
| AD-901372.1 | 85.7 | 9.4 | 103.1 | 18.7 | 89.3 | 4.3 | 89.9 | 12.5 | 100.5 | 7.7 | 97.0 | 20.4 | 73.8 | 9.6 | 47.5 | 4.4 |
| AD-901425.1 | 86.6 | 13.9 | 104.1 | 15.8 | 100.2 | 12.0 | 110.9 | 21.8 | 88.0 | 11.6 | 66.1 | 22.7 | 87.1 | 20.1 | 74.9 | 17.6 |
| AD-901409.1 | 110.5 | 16.6 | 106.3 | 26.4 | 112.3 | 10.1 | 98.9 | 9.1 | 102.0 | 12.9 | 53.7 | 18.0 | 90.5 | 8.8 | 87.0 | 24.0 |
| AD-901418.1 | 91.4 | 17.7 | 106.6 | 12.5 | 104.2 | 5.8 | 115.4 | 41.5 | 84.9 | 16.8 | 58.5 | 14.0 | 94.1 | 2.4 | 79.4 | 3.5 |
| AD-901393.1 | 95.9 | 14.4 | 107.2 | 19.2 | 104.5 | 7.5 | 79.9 | 14.8 | 95.8 | 15.0 | 101.9 | 28.1 | 94.8 | 18.2 | 65.6 | 22.0 |
| AD-901388.1 | 83.2 | 14.1 | 108.9 | 4.0 | 102.2 | 9.0 | 96.5 | 10.3 | 69.7 | 4.2 | 93.0 | 12.0 | 90.5 | 5.4 | 63.6 | 22.4 |
| AD-901404.1 | 99.7 | 7.5 | 110.2 | 6.7 | 119.3 | 24.1 | 94.8 | 6.8 | 130.3 | 22.2 | 108.2 | 6.2 | 83.6 | 13.6 | 84.4 | 9.4 |
| AD-901346.1 | 78.3 | 11.7 | 110.7 | 28.7 | 97.5 | 15.9 | 70.1 | 4.8 | 89.4 | 8.0 | 75.4 | 20.2 | 76.7 | 24.4 | 105.1 | 10.9 |

TABLE 6A-continued

| VEGF-A endogenous in vitro multi-dose screen with one set of exemplary human VEGF-A siRNAs | | | | | | | | | | | | | | | | |
|---|---|---|---|---|---|---|---|---|---|---|---|---|---|---|---|---|
| | ARPE-19 | | | | | | | | hTERT RPE-1 | | | | | | | |
| Sample_Name | 50 nM | StDev | 10 nM | StDev | 1 nM | StDev | 0.1 nM | StDev | 50 nM | StDev | 10 nM | StDev | 1 nM | StDev | 0.1 nM | StDev |
| AD-901403.1 | 92.7 | 11.1 | 111.4 | 9.2 | 101.5 | 5.3 | 96.1 | 9.3 | 94.2 | 13.5 | 111.6 | 19.8 | 79.3 | 7.0 | 62.3 | 6.4 |
| AD-901396.1 | 95.6 | 12.6 | 112.1 | 20.6 | 101.1 | 10.1 | 97.7 | 11.4 | 88.7 | 6.9 | 116.5 | 36.0 | 89.3 | 3.2 | 79.8 | 22.4 |
| AD-901432.1 | 86.4 | 16.0 | 113.4 | 16.6 | 68.0 | 6.3 | 97.4 | 15.6 | 98.3 | 13.9 | 67.9 | 6.9 | 81.5 | 17.3 | 77.7 | 17.1 |
| AD-901435.1 | 93.4 | 6.6 | 115.4 | 12.9 | 82.5 | 12.0 | 97.1 | 10.8 | 100.4 | 9.0 | 68.1 | 31.6 | 82.2 | 25.7 | 78.0 | 11.7 |
| AD-901416.1 | 103.4 | 18.0 | 116.6 | 18.3 | 110.7 | 16.3 | 98.3 | 27.8 | 102.4 | 25.4 | 77.5 | 16.6 | 100.2 | 4.4 | 82.1 | 22.3 |
| AD-901394.1 | 106.8 | 12.4 | 118.1 | 11.0 | 111.8 | 9.5 | 92.1 | 16.4 | 137.8 | 38.9 | 117.2 | 37.8 | 100.6 | 17.2 | 71.2 | 11.1 |
| AD-901429.1 | 94.4 | 7.7 | 118.8 | 28.5 | 93.2 | 6.7 | 101.2 | 12.0 | 92.5 | 7.3 | 64.3 | 18.4 | 85.1 | 6.6 | 75.3 | 16.0 |
| AD-901402.1 | 99.4 | 13.8 | 118.9 | 25.5 | 107.3 | 6.3 | 100.5 | 9.5 | 99.8 | 15.7 | 108.9 | 8.5 | 94.6 | 9.5 | 75.2 | 18.7 |
| AD-901430.1 | 95.7 | 16.4 | 119.8 | 30.7 | 82.8 | 5.5 | 98.2 | 12.4 | 95.2 | 10.9 | 90.0 | 30.2 | 72.8 | 6.4 | 74.4 | 9.7 |
| AD-901369.1 | 79.4 | 12.7 | 135.3 | 57.4 | 89.5 | 2.4 | 75.0 | 10.6 | 112.5 | 21.8 | 82.9 | 15.8 | 88.4 | 2.8 | 66.5 | 21.4 |

TABLE 6B

| VEGF-A endogenous in vitro multi-dose screen with one set of exemplary human VEGF-A siRNAs | | | | | | | | | | | | | | | | |
|---|---|---|---|---|---|---|---|---|---|---|---|---|---|---|---|---|
| | ARPE-19 | | | | | | | | hTERT RPE-1 | | | | | | | |
| Sample Name | 50 nM | StDev | 10 nM | StDev | 1 nM | StDev | 0.1 nM | StDev | 50 nM | StDev | 10 nM | StDev | 1 nM | StDev | 0.1 nM | StDev |
| AD-953340.1 | 18.6 | 2.1 | 2.7 | 0.7 | 28.5 | 3.4 | 106.5 | 28.3 | 40.1 | 3.9 | 25.2 | 10.0 | 38.7 | 7.5 | 52.2 | 15.2 |
| AD-953336.1 | 25.7 | 1.4 | 3.7 | 0.9 | 26.5 | 0.5 | 159.2 | 61.6 | 45.5 | 5.2 | 26.3 | 8.1 | 41.0 | 8.9 | 68.2 | 8.3 |
| AD-953363.1 | 17.3 | 2.9 | 3.9 | 0.9 | 33.5 | 6.0 | 57.0 | 7.1 | 37.2 | 6.8 | 24.6 | 5.6 | 38.1 | 5.9 | 39.4 | 8.0 |
| AD-953338.1 | 23.1 | 2.7 | 4.8 | 1.8 | 41.2 | 8.4 | 92.1 | 21.1 | 54.6 | 7.9 | 35.3 | 7.5 | 51.1 | 1.4 | 76.1 | 10.8 |
| AD-953367.1 | 25.6 | 1.6 | 5.1 | 0.6 | 39.3 | 6.9 | 55.8 | 5.1 | 62.2 | 8.0 | 33.2 | 10.3 | 61.2 | 8.6 | 49.4 | 7.6 |
| AD-953337.1 | 29.5 | 4.0 | 5.6 | 3.4 | 28.2 | 2.0 | 129.8 | 30.5 | 45.4 | 8.6 | 23.8 | 4.5 | 44.8 | 3.6 | 60.6 | 8.0 |
| AD-953342.1 | 18.9 | 2.3 | 5.6 | 3.6 | 31.6 | 4.9 | 149.8 | 56.1 | 35.2 | 4.0 | 28.4 | 6.6 | 39.0 | 2.7 | 73.7 | 11.9 |
| AD-953350.1 | 30.0 | 3.6 | 5.8 | 4.1 | 46.6 | 8.3 | 78.3 | 22.9 | 70.5 | 10.7 | 42.6 | 14.8 | 49.3 | 14.2 | 85.8 | 3.8 |
| AD-953352.1 | 28.5 | 2.8 | 6.1 | 0.5 | 41.5 | 5.7 | 113.4 | 13.2 | 52.8 | 5.8 | 40.1 | 9.3 | 53.0 | 7.6 | 72.9 | 7.3 |
| AD-953368.1 | 33.3 | 1.6 | 6.2 | 1.0 | 35.2 | 2.3 | 48.2 | 3.6 | 58.8 | 5.7 | 39.5 | 11.2 | 50.1 | 7.2 | 50.5 | 2.2 |
| AD-953344.1 | 17.8 | 1.6 | 6.5 | 1.9 | 38.5 | 5.7 | 66.5 | 11.3 | 29.5 | 4.0 | 28.9 | 7.1 | 49.6 | 7.0 | 75.8 | 12.9 |
| AD-953339.1 | 26.5 | 4.9 | 6.7 | 5.5 | 34.4 | 6.2 | 120.0 | 30.4 | 41.7 | 3.6 | 26.2 | 3.7 | 36.0 | 9.0 | 59.1 | 7.0 |
| AD-953387.1 | 20.6 | 1.0 | 6.9 | 0.3 | 40.9 | 5.4 | 64.9 | 6.1 | 21.0 | 2.8 | 31.3 | 5.4 | 69.7 | 15.0 | 57.4 | 7.3 |
| AD-953375.1 | 37.1 | 2.8 | 7.4 | 1.1 | 48.8 | 6.5 | 73.4 | 3.9 | 90.7 | 19.7 | 62.5 | 8.1 | 72.2 | 11.9 | 64.3 | 16.3 |
| AD-953355.1 | 42.7 | 5.3 | 7.5 | 0.7 | 62.2 | 2.4 | 137.9 | 24.5 | 43.9 | 5.5 | 40.6 | 8.0 | 52.6 | 10.0 | 67.1 | 5.5 |
| AD-953341.1 | 20.2 | 2.9 | 7.7 | 4.5 | 22.3 | 3.3 | 106.6 | 21.7 | 55.5 | 5.5 | 34.7 | 7.7 | 32.2 | 8.3 | 68.4 | 5.8 |
| AD-953370.1 | 36.8 | 3.0 | 7.8 | 1.9 | 55.5 | 7.5 | 72.3 | 6.0 | 38.0 | 7.8 | 26.9 | 4.7 | 63.9 | 12.6 | 51.9 | 6.9 |
| AD-953362.1 | 57.6 | 4.3 | 8.2 | 1.1 | 54.3 | 8.3 | 76.8 | 3.6 | 108.9 | 11.3 | 48.1 | 10.1 | 63.0 | 11.0 | 52.1 | 10.4 |
| AD-953322.1 | 59.6 | 3.6 | 8.2 | 1.3 | 61.4 | 4.5 | 105.4 | 14.2 | 103.5 | 9.6 | 55.4 | 15.9 | 66.5 | 7.4 | 78.4 | 11.5 |
| AD-953332.1 | 59.2 | 3.3 | 8.3 | 1.3 | 58.3 | 3.8 | 106.7 | 20.6 | 95.1 | 15.8 | 55.0 | 9.1 | 74.5 | 1.5 | 66.2 | 8.9 |
| AD-953371.1 | 41.1 | 3.2 | 8.5 | 2.6 | 49.1 | 7.2 | 64.1 | 10.0 | 75.1 | 16.0 | 51.2 | 18.1 | 60.0 | 8.7 | 53.0 | 11.6 |
| AD-953331.1 | 68.0 | 1.2 | 8.8 | 1.7 | 60.3 | 5.5 | 92.6 | 24.7 | 151.3 | 18.2 | 88.8 | 33.3 | 85.2 | 21.0 | 87.4 | 5.6 |
| AD-953323.1 | 66.8 | 5.0 | 9.1 | 1.7 | 64.2 | 2.1 | 109.8 | 19.9 | 93.6 | 2.2 | 53.0 | 7.3 | 74.7 | 4.9 | 77.0 | 11.6 |
| AD-953351.1 | 21.2 | 2.3 | 9.2 | 9.5 | 39.8 | 6.9 | 74.4 | 8.0 | 49.7 | 3.2 | 26.0 | 2.5 | 41.2 | 11.0 | 63.6 | 8.2 |
| AD-953386.1 | 31.8 | 1.6 | 9.3 | 1.0 | 65.3 | 6.3 | 87.4 | 5.1 | 38.7 | 0.4 | 50.4 | 11.0 | 82.9 | 17.7 | 67.9 | 13.0 |
| AD-953394.1 | 35.4 | 2.0 | 9.5 | 5.1 | 50.8 | 5.3 | 72.7 | 3.3 | 66.5 | 16.5 | 49.7 | 10.5 | 77.2 | 14.7 | 57.8 | 21.7 |
| AD-953359.1 | 36.4 | 3.8 | 9.7 | 2.9 | 46.9 | 6.3 | 72.9 | 7.4 | 74.8 | 9.6 | 46.2 | 6.0 | 63.9 | 10.8 | 50.7 | 7.9 |
| AD-953329.1 | 68.0 | 10.2 | 9.7 | 1.7 | 59.7 | 1.6 | 100.3 | 22.8 | 94.3 | 7.1 | 56.9 | 16.4 | 76.7 | 10.0 | 79.8 | 9.0 |
| AD-953361.1 | 45.2 | 2.9 | 10.4 | 8.6 | 53.6 | 4.8 | 68.4 | 5.4 | 78.6 | 10.9 | 50.2 | 11.3 | 68.6 | 9.3 | 47.8 | 9.6 |
| AD-953319.1 | 100.2 | 2.8 | 10.6 | 1.4 | 71.5 | 10.3 | 161.5 | 76.4 | 189.6 | 19.4 | 69.0 | 22.5 | 84.3 | 4.7 | 93.2 | 18.2 |
| AD-953360.1 | 96.2 | 10.8 | 10.7 | 1.5 | 49.6 | 5.2 | 76.7 | 6.2 | 140.9 | 16.5 | 69.1 | 20.5 | 82.4 | 9.0 | 54.9 | 2.8 |
| AD-953324.1 | 63.0 | 2.8 | 11.2 | 4.8 | 53.8 | 4.5 | 96.6 | 27.2 | 131.1 | 18.6 | 67.5 | 16.9 | 86.3 | 18.2 | 75.5 | 18.1 |
| AD-953378.1 | 57.9 | 8.3 | 11.5 | 2.3 | 72.2 | 7.6 | 92.4 | 6.2 | 47.1 | 10.1 | 55.3 | 8.2 | 85.7 | 17.9 | 60.5 | 14.4 |
| AD-953369.1 | 43.6 | 4.7 | 11.8 | 6.0 | 64.4 | 10.3 | 79.8 | 5.1 | 68.6 | 9.7 | 56.3 | 9.1 | 70.2 | 5.4 | 58.7 | 14.7 |
| AD-953347.1 | 77.6 | 5.1 | 11.9 | 3.7 | 63.3 | 7.7 | 66.5 | 16.2 | 112.3 | 25.0 | 62.1 | 13.1 | 62.8 | 13.8 | 76.4 | 6.3 |
| AD-953365.1 | 28.7 | 4.1 | 12.3 | 3.5 | 35.7 | 4.9 | 61.7 | 7.9 | 36.6 | 7.3 | 23.6 | 5.0 | 56.5 | 3.9 | 50.9 | 4.6 |
| AD-953374.1 | 10.7 | 0.3 | 12.3 | 18.3 | 35.8 | 27.4 | 33.8 | 7.4 | 30.0 | 3.5 | 33.2 | 4.8 | 39.2 | 4.0 | 46.2 | 7.9 |
| AD-953384.1 | 57.1 | 2.9 | 12.9 | 4.8 | 76.3 | 9.0 | 82.4 | 5.1 | 86.2 | 5.2 | 67.4 | 3.8 | 105.9 | 23.9 | 66.1 | 13.2 |
| AD-953376.1 | 57.8 | 2.7 | 12.9 | 2.0 | 81.7 | 9.3 | 94.3 | 1.0 | 69.2 | 14.7 | 73.1 | 23.1 | 96.7 | 8.4 | 70.3 | 10.8 |
| AD-953354.1 | 49.1 | 5.5 | 13.5 | 5.6 | 67.9 | 5.6 | 141.1 | 30.9 | 40.5 | 6.7 | 42.2 | 10.8 | 57.0 | 6.1 | 78.8 | 9.6 |
| AD-953385.1 | 65.0 | 3.9 | 13.5 | 2.0 | 79.8 | 8.9 | 97.1 | 13.1 | 115.8 | 16.5 | 107.5 | 18.6 | 124.6 | 8.8 | 71.9 | 7.1 |
| AD-953346.1 | 38.0 | 3.2 | 14.1 | 11.9 | 56.3 | 4.7 | 68.3 | 13.8 | 58.6 | 8.1 | 42.7 | 7.4 | 53.9 | 11.6 | 75.2 | 5.3 |
| AD-953366.1 | 28.1 | 3.0 | 14.3 | 18.9 | 47.6 | 4.2 | 72.4 | 7.9 | 47.0 | 5.3 | 32.5 | 6.0 | 40.4 | 8.8 | 61.7 | 14.1 |
| AD-953382.1 | 67.1 | 5.3 | 14.6 | 3.6 | 80.8 | 7.7 | 99.5 | 6.7 | 143.5 | 30.8 | 67.6 | 18.2 | 91.3 | 11.9 | 67.0 | 12.6 |
| AD-953320.1 | 65.2 | 3.4 | 14.7 | 6.0 | 69.8 | 9.1 | 139.3 | 11.6 | 121.6 | 7.8 | 55.2 | 11.1 | 97.9 | 7.0 | 92.3 | 10.4 |
| AD-953379.1 | 64.5 | 8.5 | 17.0 | 5.4 | 76.3 | 3.5 | 85.5 | 6.7 | 60.1 | 12.9 | 68.0 | 26.1 | 85.4 | 3.5 | 49.6 | 12.0 |
| AD-953321.1 | 66.2 | 5.0 | 17.1 | 13.7 | 58.7 | 5.7 | 125.7 | 34.8 | 111.0 | 19.6 | 59.2 | 14.5 | 72.7 | 12.4 | 80.3 | 11.7 |
| AD-953377.1 | 55.4 | 3.9 | 17.2 | 8.0 | 75.0 | 6.1 | 83.8 | 4.1 | 54.9 | 8.5 | 57.6 | 9.1 | 82.9 | 6.1 | 70.7 | 12.3 |
| AD-953392.1 | 88.8 | 1.4 | 17.5 | 2.0 | 90.9 | 10.8 | 96.0 | 3.6 | 125.6 | 16.1 | 102.0 | 20.4 | 117.0 | 26.2 | 88.2 | 14.3 |
| AD-953373.1 | 35.7 | 3.9 | 17.7 | 12.7 | 41.4 | 3.3 | 61.2 | 9.4 | 56.7 | 9.0 | 50.8 | 5.4 | 66.6 | 5.1 | 70.4 | 14.3 |

TABLE 6B-continued

VEGF-A endogenous in vitro multi-dose screen with one set of exemplary human VEGF-A siRNAs

| | ARPE-19 | | | | | | | | hTERT RPE-1 | | | | | | | |
|---|---|---|---|---|---|---|---|---|---|---|---|---|---|---|---|---|
| Sample Name | 50 nM | StDev | 10 nM | StDev | 1 nM | StDev | 0.1 nM | StDev | 50 nM | StDev | 10 nM | StDev | 1 nM | StDev | 0.1 nM | StDev |
| AD-953364.1 | 22.5 | 1.9 | 18.1 | 6.4 | 35.7 | 2.4 | 53.4 | 3.8 | 21.2 | 2.6 | 20.1 | 5.9 | 30.5 | 4.3 | 45.0 | 7.9 |
| AD-953330.1 | 56.3 | 6.5 | 18.2 | 8.1 | 54.0 | 2.8 | 97.5 | 23.3 | 109.0 | 14.5 | 69.9 | 11.8 | 68.7 | 8.6 | 74.6 | 9.6 |
| AD-953353.1 | 30.9 | 2.4 | 19.3 | 14.9 | 51.1 | 3.9 | 145.6 | 33.7 | 59.1 | 11.7 | 45.4 | 10.7 | 57.3 | 8.9 | 80.5 | 6.8 |
| AD-953343.1 | 28.4 | 1.6 | 19.4 | 24.7 | 31.5 | 2.1 | 50.2 | 12.1 | 51.1 | 7.7 | 41.1 | 4.8 | 50.6 | 3.0 | 76.9 | 6.2 |
| AD-953390.1 | 82.4 | 4.8 | 19.8 | 2.3 | 92.7 | 10.4 | 103.4 | 7.6 | 132.1 | 19.0 | 96.0 | 20.4 | 114.6 | 24.4 | 80.3 | 14.4 |
| AD-953345.1 | 26.9 | 4.4 | 20.4 | 16.6 | 51.9 | 6.3 | 91.9 | 13.0 | 35.7 | 10.4 | 33.1 | 6.6 | 37.6 | 9.9 | 65.9 | 6.8 |
| AD-953358.1 | 30.5 | 1.7 | 20.6 | 17.0 | 40.7 | 6.0 | 66.2 | 3.7 | 67.1 | 7.3 | 46.2 | 13.7 | 62.8 | 16.0 | 52.4 | 10.8 |
| AD-953383.1 | 58.5 | 4.0 | 21.4 | 9.2 | 65.7 | 5.7 | 83.3 | 3.1 | 70.5 | 9.4 | 65.2 | 10.6 | 82.7 | 14.0 | 80.7 | 8.9 |
| AD-953372.1 | 34.3 | 4.8 | 24.0 | 7.7 | 45.9 | 5.8 | 65.7 | 4.7 | 52.6 | 5.2 | 42.1 | 13.1 | 65.9 | 9.1 | 54.7 | 6.6 |
| AD-953328.1 | 54.5 | 3.9 | 24.1 | 19.0 | 60.6 | 5.7 | 112.1 | 3.8 | 137.7 | 50.8 | 66.1 | 5.8 | 82.7 | 13.1 | 79.1 | 7.2 |
| AD-953393.1 | 42.8 | 3.6 | 25.9 | 33.0 | 63.6 | 6.1 | 87.9 | 3.4 | 49.7 | 9.2 | 56.8 | 6.9 | 81.0 | 6.8 | 74.0 | 14.3 |
| AD-953307.1 | 39.3 | 2.0 | 26.1 | 2.3 | 50.3 | 3.0 | 144.4 | 30.6 | 49.9 | 4.0 | 34.1 | 7.3 | 65.1 | 4.0 | 56.8 | 9.9 |
| AD-953308.1 | 36.9 | 6.6 | 26.3 | 1.3 | 50.9 | 3.7 | 136.2 | 32.8 | 30.3 | 7.1 | 24.2 | 4.4 | 53.4 | 4.8 | 42.3 | 8.9 |
| AD-953327.1 | 63.7 | 9.2 | 27.4 | 29.5 | 52.5 | 1.5 | 108.8 | 24.5 | 85.5 | 42.1 | 48.8 | 10.7 | 72.2 | 10.9 | 82.3 | 7.2 |
| AD-953335.1 | 77.1 | 5.8 | 28.3 | 19.0 | 53.0 | 4.4 | 115.1 | 32.1 | 144.1 | 17.3 | 72.8 | 17.2 | 84.8 | 11.6 | 95.4 | 8.0 |
| AD-953414.1 | 21.5 | 1.7 | 28.3 | 1.6 | 41.8 | 4.6 | 61.5 | 8.3 | 40.1 | 2.5 | 31.3 | 7.9 | 49.3 | 12.3 | 66.0 | 17.8 |
| AD-953412.1 | 16.3 | 0.7 | 28.4 | 3.6 | 33.1 | 5.3 | 65.1 | 4.0 | 37.5 | 11.0 | 35.3 | 3.6 | 35.8 | 9.0 | 70.7 | 14.2 |
| AD-953411.1 | 15.4 | 2.0 | 29.5 | 3.7 | 42.7 | 5.0 | 65.5 | 6.0 | 30.9 | 9.0 | 26.2 | 4.3 | 48.9 | 7.9 | 57.2 | 13.3 |
| AD-953410.1 | 16.4 | 1.2 | 29.6 | 2.0 | 44.7 | 3.6 | 68.0 | 2.7 | 26.2 | 3.8 | 26.4 | 7.0 | 49.8 | 9.2 | 55.9 | 17.7 |
| AD-953408.1 | 21.0 | 1.4 | 29.7 | 2.3 | 38.4 | 4.8 | 72.1 | 6.4 | 33.1 | 4.7 | 35.5 | 2.9 | 60.9 | 14.6 | 80.9 | 23.6 |
| AD-953326.1 | 53.8 | 7.2 | 30.2 | 17.6 | 50.4 | 3.4 | 115.3 | 25.4 | 115.2 | 12.1 | 59.7 | 19.5 | 77.5 | 18.1 | 83.0 | 11.6 |
| AD-953300.1 | 49.4 | 5.2 | 30.6 | 1.7 | 52.2 | 5.5 | 176.7 | 31.5 | 51.7 | 16.4 | 44.1 | 6.6 | 65.9 | 17.3 | 39.7 | 7.3 |
| AD-953389.1 | 90.9 | 7.3 | 31.6 | 16.2 | 93.6 | 8.0 | 99.4 | 7.4 | 144.1 | 18.2 | 126.7 | 8.2 | 114.4 | 15.0 | 93.8 | 22.2 |
| AD-953415.1 | 23.3 | 1.8 | 32.0 | 1.8 | 41.3 | 3.0 | 62.8 | 8.8 | 65.9 | 6.6 | 52.5 | 5.9 | 53.3 | 18.2 | 70.5 | 19.8 |
| AD-953309.1 | 42.1 | 1.6 | 32.3 | 3.0 | 69.9 | 2.0 | 148.4 | 9.6 | 40.6 | 7.2 | 42.0 | 7.1 | 91.4 | 19.0 | 48.5 | 11.7 |
| AD-953391.1 | 78.3 | 7.4 | 32.9 | 32.3 | 86.1 | 7.2 | 95.6 | 4.9 | 108.7 | 4.5 | 93.3 | 10.9 | 119.0 | 24.5 | 87.2 | 15.4 |
| AD-953395.1 | 53.9 | 5.2 | 33.3 | 21.8 | 70.2 | 7.5 | 87.9 | 3.9 | 42.9 | 5.1 | 49.4 | 8.8 | 83.2 | 6.3 | 62.2 | 11.3 |
| AD-953303.1 | 48.8 | 2.8 | 34.0 | 9.2 | 44.4 | 3.8 | 133.6 | 33.0 | 69.9 | 7.6 | 42.4 | 3.8 | 62.7 | 7.0 | 54.4 | 12.6 |
| AD-953405.1 | 37.6 | 9.8 | 34.2 | 5.3 | 42.1 | 8.8 | 60.5 | 3.6 | 58.3 | 17.4 | 37.6 | 7.0 | 59.1 | 16.6 | 78.3 | 6.9 |
| AD-953305.1 | 52.0 | 6.9 | 34.8 | 1.6 | 56.5 | 5.1 | 108.4 | 23.2 | 73.0 | 10.3 | 41.9 | 6.0 | 68.4 | 9.8 | 69.3 | 6.9 |
| AD-953380.1 | 63.5 | 8.0 | 35.1 | 28.6 | 72.8 | 5.2 | 84.6 | 3.4 | 54.0 | 2.4 | 49.6 | 9.1 | 82.2 | 16.6 | 54.1 | 9.0 |
| AD-953349.1 | 62.9 | 2.8 | 35.3 | 4.1 | 61.4 | 6.2 | 71.3 | 23.0 | 106.7 | 20.9 | 64.7 | 14.2 | 67.5 | 26.3 | 92.3 | 7.5 |
| AD-953381.1 | 66.3 | 2.9 | 35.5 | 22.1 | 83.5 | 7.5 | 99.8 | 6.3 | 80.8 | 10.0 | 67.8 | 8.9 | 99.2 | 18.4 | 76.9 | 21.1 |
| AD-953318.1 | 73.1 | 4.0 | 37.6 | 32.2 | 63.4 | 2.6 | 198.1 | 91.7 | 132.1 | 16.9 | 66.1 | 30.7 | 81.7 | 17.2 | 88.7 | 3.1 |
| AD-953348.1 | 46.6 | 2.7 | 38.4 | 9.6 | 52.5 | 5.4 | 136.3 | 31.4 | 46.5 | 14.1 | 38.9 | 9.4 | 48.8 | 9.2 | 74.5 | 10.8 |
| AD-953409.1 | 24.1 | 1.4 | 39.4 | 2.8 | 46.7 | 7.0 | 76.5 | 7.7 | 32.7 | 3.5 | 28.5 | 4.8 | 59.1 | 9.8 | 65.9 | 21.4 |
| AD-953306.1 | 69.9 | 8.3 | 39.7 | 4.7 | 62.4 | 5.2 | 134.9 | 32.7 | 127.5 | 9.5 | 69.9 | 20.8 | 84.4 | 4.7 | 44.9 | 5.0 |
| AD-953316.1 | 59.6 | 4.5 | 40.3 | 3.9 | 54.4 | 3.5 | 94.5 | 8.4 | 129.3 | 20.3 | 58.5 | 9.4 | 72.2 | 12.8 | 58.6 | 15.8 |
| AD-953325.1 | 69.2 | 6.7 | 41.8 | 24.8 | 68.9 | 7.7 | 153.7 | 53.1 | 112.9 | 25.0 | 66.6 | 11.7 | 76.9 | 13.0 | 70.1 | 9.9 |
| AD-953299.1 | 64.9 | 6.3 | 42.3 | 2.6 | 70.3 | 5.0 | 164.5 | 59.7 | 67.8 | 20.4 | 65.1 | 16.9 | 83.0 | 9.2 | 50.0 | 7.5 |
| AD-953416.1 | 29.1 | 3.7 | 42.4 | 3.1 | 41.8 | 3.8 | 53.8 | 4.6 | 79.4 | 10.1 | 51.0 | 9.1 | 57.1 | 5.1 | 63.4 | 7.3 |
| AD-953315.1 | 62.1 | 5.3 | 42.6 | 1.1 | 55.8 | 2.8 | 95.3 | 27.0 | 134.9 | 23.0 | 84.8 | 6.7 | 73.0 | 6.5 | 58.6 | 17.0 |
| AD-953314.1 | 55.4 | 5.5 | 42.6 | 2.8 | 55.8 | 3.3 | 115.4 | 15.1 | 106.7 | 3.2 | 62.9 | 8.0 | 81.7 | 8.5 | 53.3 | 21.1 |
| AD-953298.1 | 65.3 | 4.3 | 44.0 | 2.2 | 67.5 | 6.6 | 165.9 | 13.3 | 60.5 | 6.8 | 46.5 | 9.6 | 89.0 | 8.6 | 57.6 | 7.6 |
| AD-953406.1 | 27.2 | 1.4 | 44.5 | 5.0 | 58.8 | 5.8 | 84.3 | 2.0 | 50.0 | 4.6 | 37.8 | 4.4 | 74.7 | 8.6 | 75.2 | 29.3 |
| AD-953399.1 | 32.1 | 2.3 | 45.5 | 1.4 | 44.3 | 3.6 | 64.6 | 2.8 | 84.3 | 9.4 | 43.2 | 8.2 | 80.6 | 5.7 | 79.7 | 20.7 |
| AD-953333.1 | 54.7 | 4.9 | 45.7 | 17.9 | 63.1 | 3.7 | 139.5 | 14.5 | 104.8 | 10.4 | 50.6 | 15.6 | 65.9 | 13.4 | 66.1 | 14.1 |
| AD-953313.1 | 57.3 | 3.7 | 45.9 | 2.5 | 64.6 | 2.4 | 107.6 | 22.5 | 81.2 | 19.1 | 61.7 | 8.4 | 89.7 | 4.0 | 83.2 | 4.5 |
| AD-953302.1 | 49.5 | 2.8 | 47.0 | 5.0 | 61.7 | 3.9 | 108.3 | 31.0 | 41.6 | 11.9 | 48.7 | 7.2 | 57.5 | 8.9 | 68.8 | 4.8 |
| AD-953317.1 | 76.9 | 5.3 | 50.0 | 3.1 | 72.6 | 9.3 | 145.3 | 34.8 | 77.9 | 18.1 | 60.9 | 12.4 | 71.3 | 9.7 | 50.4 | 14.7 |
| AD-953357.1 | 61.0 | 5.5 | 50.3 | 33.1 | 70.6 | 8.6 | 94.4 | 5.1 | 70.4 | 16.9 | 59.5 | 19.7 | 99.6 | 27.9 | 52.4 | 8.5 |
| AD-953301.1 | 62.2 | 7.8 | 50.5 | 5.6 | 82.8 | 5.7 | 193.0 | 33.0 | 47.3 | 16.7 | 38.2 | 3.8 | 63.5 | 8.8 | 53.8 | 10.8 |
| AD-953304.1 | 60.9 | 6.6 | 51.4 | 2.2 | 75.4 | 1.9 | 133.7 | 36.1 | 133.7 | 5.8 | 89.6 | 12.1 | 95.5 | 8.0 | 65.9 | 8.4 |
| AD-953297.1 | 77.5 | 3.2 | 52.2 | 4.2 | 74.9 | 4.8 | 142.3 | 32.5 | 118.2 | 19.7 | 85.8 | 5.2 | 99.1 | 11.6 | 59.7 | 8.0 |
| AD-953388.1 | 80.1 | 5.6 | 53.7 | 40.5 | 91.0 | 9.7 | 95.9 | 10.1 | 139.5 | 8.4 | 89.7 | 6.8 | 107.9 | 17.8 | 98.0 | 21.3 |
| AD-953407.1 | 37.2 | 4.3 | 53.9 | 9.4 | 47.8 | 6.2 | 72.1 | 4.3 | 61.2 | 7.6 | 43.4 | 16.4 | 66.1 | 17.3 | 74.5 | 6.9 |
| AD-953397.1 | 56.1 | 5.0 | 57.1 | 3.8 | 58.1 | 9.9 | 77.8 | 5.1 | 96.4 | 13.5 | 52.9 | 9.6 | 94.9 | 13.8 | 76.0 | 9.4 |
| AD-953398.1 | 47.8 | 2.1 | 57.4 | 6.6 | 51.1 | 5.3 | 71.6 | 2.3 | 62.1 | 7.0 | 51.9 | 7.5 | 99.5 | 13.7 | 93.8 | 13.7 |
| AD-953396.1 | 52.3 | 7.4 | 59.5 | 5.6 | 63.4 | 6.2 | 86.9 | 5.8 | 85.3 | 10.0 | 52.7 | 5.7 | 98.7 | 8.2 | 101.8 | 11.6 |
| AD-953356.1 | 80.6 | 1.8 | 63.1 | 11.3 | 82.1 | 13.5 | 119.0 | 27.2 | 93.5 | 11.4 | 65.8 | 9.2 | 76.8 | 20.8 | 61.8 | 12.3 |
| AD-953422.1 | 47.6 | 4.2 | 63.3 | 7.6 | 189.1 | 56.5 | 87.2 | 3.9 | 56.5 | 5.7 | 58.9 | 8.6 | 36.4 | 2.3 | 74.3 | 18.0 |
| AD-953413.1 | 56.5 | 4.9 | 64.0 | 8.2 | 68.9 | 4.5 | 95.5 | 9.7 | 78.1 | 8.7 | 72.4 | 12.0 | 81.1 | 9.4 | 90.4 | 15.6 |
| AD-953294.1 | 97.1 | 15.2 | 64.2 | 4.2 | 77.3 | 15.5 | 96.7 | 15.6 | 96.8 | 35.0 | 71.6 | 5.9 | 76.3 | 3.3 | 69.9 | 12.0 |
| AD-953421.1 | 53.2 | 6.7 | 65.0 | 2.9 | 197.8 | 29.8 | 101.0 | 7.9 | 102.0 | 13.5 | 65.6 | 7.9 | 49.4 | 12.2 | 94.1 | 8.4 |
| AD-953310.1 | 117.3 | 11.7 | 66.7 | 16.2 | 93.9 | 3.2 | 148.4 | 45.0 | 149.3 | 31.4 | 91.4 | 14.3 | 97.9 | 3.5 | 72.3 | 17.0 |
| AD-953296.1 | 103.9 | 2.9 | 67.6 | 5.3 | 85.2 | 8.1 | 137.2 | 17.9 | 187.5 | 42.8 | 110.2 | 4.6 | 116.2 | 10.5 | 56.8 | 9.4 |
| AD-953402.1 | 55.1 | 2.2 | 67.6 | 4.0 | 63.8 | 6.1 | 84.1 | 7.6 | 83.2 | 19.9 | 75.6 | 8.7 | 89.0 | 23.0 | 77.5 | 11.6 |
| AD-953312.1 | 86.0 | 14.3 | 71.1 | 4.1 | 74.3 | 3.3 | 145.1 | 57.4 | 171.9 | 22.0 | 84.6 | 5.5 | 100.5 | 13.7 | 94.5 | 9.6 |
| AD-953295.1 | 94.5 | 4.7 | 71.6 | 3.7 | 83.7 | 11.4 | 136.9 | 20.4 | 122.9 | 21.2 | 90.4 | 14.2 | 85.2 | 26.5 | 64.3 | 18.0 |
| AD-953420.1 | 58.3 | 2.3 | 72.8 | 7.3 | 177.1 | 37.4 | 91.6 | 3.5 | 74.6 | 3.6 | 60.0 | 6.7 | 52.2 | 7.9 | 96.5 | 11.0 |
| AD-953423.1 | 47.1 | 3.4 | 73.0 | 14.3 | 215.7 | 13.2 | 93.0 | 6.7 | 90.7 | 6.7 | 64.9 | 9.2 | 43.6 | 7.2 | 89.1 | 15.2 |
| AD-953403.1 | 62.9 | 12.6 | 73.9 | 5.6 | 58.5 | 5.9 | 77.8 | 6.5 | 102.6 | 12.5 | 62.1 | 6.0 | 96.2 | 14.6 | 75.4 | 7.3 |
| AD-953400.1 | 52.1 | 2.7 | 74.8 | 10.9 | 58.9 | 4.4 | 78.3 | 6.7 | 83.2 | 11.5 | 48.5 | 14.9 | 86.8 | 26.5 | 84.6 | 8.4 |

TABLE 6B-continued

VEGF-A endogenous in vitro multi-dose screen with one set of exemplary human VEGF-A siRNAs

| | ARPE-19 | | | | | | | | hTERT RPE-1 | | | | | | | |
|---|---|---|---|---|---|---|---|---|---|---|---|---|---|---|---|---|
| Sample Name | 50 nM | StDev | 10 nM | StDev | 1 nM | StDev | 0.1 nM | StDev | 50 nM | StDev | 10 nM | StDev | 1 nM | StDev | 0.1 nM | StDev |
| AD-953404.1 | 73.3 | 4.0 | 76.2 | 8.8 | 72.0 | 3.4 | 92.1 | 3.5 | 133.1 | 19.8 | 70.7 | 8.1 | 103.8 | 14.5 | 97.1 | 12.4 |
| AD-953334.1 | 59.9 | 3.8 | 76.5 | 27.3 | 57.6 | 1.4 | 115.3 | 6.2 | 178.1 | 16.6 | 89.4 | 25.1 | 78.2 | 17.1 | 98.1 | 8.5 |
| AD-953418.1 | 57.2 | 3.7 | 79.6 | 12.5 | 81.6 | 6.1 | 92.3 | 4.1 | 100.0 | 20.4 | 57.2 | 11.1 | 70.4 | 11.1 | 79.1 | 4.1 |
| AD-953401.1 | 61.5 | 3.7 | 81.6 | 4.1 | 78.6 | 9.2 | 96.9 | 10.8 | 93.0 | 8.4 | 67.9 | 27.9 | 105.6 | 5.0 | 84.0 | 6.1 |
| AD-953417.1 | 57.8 | 1.8 | 82.5 | 1.5 | 84.7 | 11.1 | 89.1 | 6.1 | 86.4 | 8.4 | 65.7 | 14.4 | 69.9 | 7.2 | 82.8 | 8.5 |
| AD-953311.1 | 113.2 | 5.8 | 91.3 | 6.1 | 93.9 | 8.2 | 108.7 | 25.4 | 156.0 | 13.3 | 86.4 | 10.1 | 92.6 | 5.7 | 77.0 | 15.2 |
| AD-953419.1 | 74.7 | 3.6 | 94.8 | 6.4 | 93.2 | 5.5 | 92.2 | 5.3 | 85.9 | 13.4 | 57.3 | 8.4 | 84.5 | 16.8 | 76.8 | 7.9 |

TABLE 6C

VEGF-A endogenous in vitro multi-dose screen with one set of exemplary human VEGF-A siRNAs

| | ARPE-19 | | | | | | | | hTERT RPE-1 | | | | | | | |
|---|---|---|---|---|---|---|---|---|---|---|---|---|---|---|---|---|
| Sample Name | 50 nM | StDev | 10 nM | StDev | 1 nM | StDev | 0.1 nM | StDev | 50 nM | StDev | 10 nM | StDev | 1 nM | StDev | 0.1 nM | StDev |
| AD-953504.1 | 17.3 | 0.6 | 19.8 | 5.4 | 48.7 | 32.4 | 56.5 | 9.3 | 19.9 | 3.2 | 22.2 | 2.8 | 61.7 | 21.8 | 65.7 | 15.9 |
| AD-953481.1 | 33.7 | 2.2 | 28.1 | 2.4 | 60.4 | 3.8 | 72.8 | 1.5 | 42.5 | 9.2 | 25.3 | 3.5 | 68.8 | 28.1 | 78.2 | 28.1 |
| AD-953472.1 | 31.3 | 1.6 | 30.1 | 1.2 | 54.1 | 4.4 | 80.0 | 6.6 | 45.9 | 7.1 | 30.6 | 2.9 | 64.9 | 14.9 | 91.0 | 18.4 |
| AD-953517.1 | 29.5 | 3.2 | 30.3 | 1.4 | 45.6 | 5.1 | 74.4 | 4.9 | 37.6 | 4.9 | 36.3 | 7.9 | 69.4 | 18.5 | 74.5 | 10.3 |
| AD-953471.1 | 33.4 | 0.9 | 30.5 | 2.2 | 47.1 | 5.1 | 87.8 | 15.3 | 39.7 | 11.2 | 28.0 | 5.0 | 68.2 | 12.1 | 77.6 | 14.1 |
| AD-953493.1 | 46.0 | 10.0 | 33.3 | 4.0 | 64.9 | 9.0 | 81.1 | 4.1 | 24.9 | 5.5 | 22.5 | 2.5 | 50.8 | 23.2 | 54.0 | 12.0 |
| AD-953498.1 | 46.8 | 3.8 | 34.5 | 1.5 | 55.9 | 5.9 | 76.7 | 8.9 | 43.1 | 2.2 | 31.2 | 4.9 | 64.8 | 16.8 | 78.0 | 19.6 |
| AD-953467.1 | 42.3 | 6.8 | 34.6 | 3.5 | 59.8 | 14.0 | 78.3 | 11.6 | 42.8 | 3.2 | 31.1 | 8.9 | 56.9 | 9.0 | 94.4 | 12.2 |
| AD-953545.1 | 31.2 | 0.8 | 35.4 | 8.1 | 48.5 | 6.1 | 73.7 | 7.0 | 55.3 | 8.9 | 42.0 | 8.6 | 85.9 | 16.6 | 79.4 | 7.1 |
| AD-953466.1 | 53.7 | 2.9 | 36.9 | 3.0 | 61.5 | 20.5 | 74.1 | 8.9 | 62.8 | 5.4 | 39.6 | 3.4 | 65.3 | 7.7 | 103.3 | 34.2 |
| AD-953494.1 | 49.2 | 2.9 | 38.4 | 1.6 | 66.3 | 7.1 | 85.6 | 4.5 | 32.7 | 3.4 | 26.5 | 8.0 | 46.1 | 7.1 | 45.7 | 6.8 |
| AD-953470.1 | 66.5 | 2.0 | 40.5 | 3.4 | 63.8 | 13.5 | 74.9 | 5.0 | 56.4 | 9.5 | 34.8 | 7.3 | 64.6 | 9.9 | 105.6 | 20.0 |
| AD-953473.1 | 59.2 | 2.9 | 42.3 | 5.7 | 61.7 | 4.1 | 80.9 | 4.5 | 72.8 | 11.9 | 44.2 | 3.0 | 77.6 | 25.2 | 110.0 | 27.1 |
| AD-953474.1 | 61.5 | 7.9 | 42.4 | 1.6 | 72.9 | 7.5 | 86.4 | 5.6 | 63.8 | 4.5 | 48.8 | 2.4 | 85.5 | 29.3 | 107.1 | 18.8 |
| AD-953480.1 | 41.7 | 3.9 | 43.3 | 1.9 | 72.9 | 5.0 | 91.6 | 11.4 | 47.1 | 9.2 | 47.2 | 16.2 | 77.8 | 38.4 | 93.8 | 27.0 |
| AD-953503.1 | 56.4 | 2.3 | 43.9 | 4.9 | 59.9 | 7.6 | 88.7 | 10.2 | 44.2 | 13.0 | 57.5 | 9.7 | 90.0 | 9.8 | 83.2 | 11.7 |
| AD-953478.1 | 55.1 | 8.7 | 44.3 | 4.1 | 64.1 | 4.5 | 83.3 | 8.7 | 38.9 | 3.2 | 52.3 | 22.9 | 70.3 | 23.4 | 78.1 | 9.5 |
| AD-953540.1 | 29.4 | 2.2 | 44.6 | 10.3 | 60.9 | 5.7 | 94.9 | 10.3 | 23.4 | 6.6 | 22.7 | 7.9 | 59.7 | 12.0 | 81.5 | 3.3 |
| AD-953500.1 | 46.3 | 10.0 | 45.8 | 4.0 | 70.6 | 10.0 | 91.2 | 4.6 | 30.4 | 4.6 | 31.2 | 1.2 | 79.7 | 16.0 | 80.1 | 10.5 |
| AD-953476.1 | 45.9 | 6.5 | 46.7 | 2.3 | 78.7 | 3.7 | 91.8 | 4.7 | 40.4 | 4.4 | 44.7 | 10.0 | 84.2 | 14.5 | 118.2 | 21.3 |
| AD-953492.1 | 61.2 | 1.9 | 47.1 | 3.8 | 71.8 | 6.2 | 85.2 | 8.4 | 58.2 | 7.0 | 44.7 | 4.1 | 79.6 | 20.6 | 73.1 | 13.5 |
| AD-953495.1 | 60.7 | 3.5 | 47.4 | 3.9 | 64.3 | 15.3 | 84.0 | 5.7 | 54.3 | 7.7 | 39.5 | 8.5 | 69.7 | 9.1 | 68.8 | 26.1 |
| AD-953497.1 | 55.5 | 1.6 | 47.9 | 5.1 | 65.9 | 9.6 | 89.9 | 8.5 | 61.5 | 11.8 | 45.8 | 11.0 | 81.4 | 21.9 | 86.5 | 11.4 |
| AD-953535.1 | 52.1 | 10.8 | 48.3 | 10.8 | 56.0 | 5.5 | 76.1 | 4.9 | 52.6 | 8.9 | 42.6 | 8.1 | 94.1 | 22.4 | 100.5 | 4.2 |
| AD-953505.1 | 60.3 | 6.1 | 48.4 | 2.0 | 64.4 | 2.4 | 94.7 | 10.5 | 54.9 | 8.8 | 59.1 | 7.3 | 104.2 | 19.2 | 88.3 | 14.3 |
| AD-953524.1 | 57.5 | 1.2 | 48.9 | 2.1 | 50.9 | 20.8 | 93.7 | 6.7 | 44.2 | 4.8 | 51.2 | 8.8 | 68.3 | 25.3 | 64.5 | 14.1 |
| AD-953475.1 | 55.7 | 2.1 | 49.6 | 3.8 | 69.2 | 7.9 | 83.9 | 5.0 | 54.2 | 11.0 | 41.8 | 8.6 | 87.2 | 24.9 | 105.6 | 23.8 |
| AD-953491.1 | 68.9 | 9.7 | 49.9 | 4.6 | 69.4 | 2.7 | 92.7 | 10.9 | 54.5 | 8.4 | 54.9 | 20.8 | 72.8 | 15.0 | 73.5 | 16.3 |
| AD-953436.1 | 96.6 | 1.6 | 50.6 | 2.1 | 63.1 | 13.9 | 80.4 | 4.8 | 72.6 | 8.9 | 72.9 | 2.2 | 108.8 | 9.8 | 67.6 | 24.6 |
| AD-953502.1 | 62.8 | 9.4 | 50.8 | 3.8 | 74.9 | 6.4 | 87.0 | 13.4 | 52.2 | 4.0 | 42.0 | 8.7 | 75.8 | 17.7 | 49.4 | 4.5 |
| AD-953461.1 | 61.7 | 5.8 | 51.1 | 5.0 | 74.3 | 17.8 | 74.6 | 2.7 | 66.9 | 10.6 | 62.6 | 8.7 | 78.9 | 3.2 | 94.0 | 19.6 |
| AD-953544.1 | 42.2 | 3.8 | 51.3 | 8.4 | 61.5 | 6.6 | 89.4 | 2.2 | 47.4 | 9.0 | 45.8 | 10.0 | 83.1 | 19.6 | 92.4 | 16.0 |
| AD-953462.1 | 64.6 | 3.0 | 51.5 | 5.9 | 84.5 | 16.8 | 80.3 | 6.5 | 53.0 | 14.9 | 48.2 | 11.8 | 84.0 | 18.2 | 114.8 | 20.3 |
| AD-953496.1 | 52.0 | 5.9 | 51.6 | 5.0 | 79.2 | 5.6 | 89.8 | 6.5 | 55.1 | 5.5 | 58.3 | 4.8 | 97.3 | 22.7 | 83.9 | 25.2 |
| AD-953516.1 | 59.7 | 7.4 | 51.9 | 2.3 | 71.2 | 11.2 | 93.4 | 13.2 | 49.8 | 14.2 | 43.5 | 13.2 | 86.5 | 9.4 | 78.4 | 11.1 |
| AD-953483.1 | 61.6 | 4.6 | 52.0 | 2.3 | 69.5 | 17.6 | 92.7 | 9.0 | 52.2 | 7.3 | 47.3 | 13.2 | 99.1 | 21.9 | 94.1 | 22.9 |
| AD-953499.1 | 64.5 | 8.2 | 52.7 | 3.2 | 71.1 | 11.7 | 105.8 | 6.7 | 70.7 | 10.1 | 46.6 | 5.0 | 90.6 | 15.3 | 85.6 | 14.6 |
| AD-953541.1 | 48.8 | 10.7 | 53.1 | 12.9 | 55.9 | 6.0 | 90.1 | 9.3 | 32.7 | 6.8 | 31.2 | 3.2 | 68.9 | 24.2 | 79.9 | 10.0 |
| AD-953538.1 | 38.4 | 5.2 | 54.1 | 10.1 | 68.1 | 9.3 | 99.0 | 6.5 | 32.1 | 8.8 | 29.3 | 3.2 | 89.4 | 17.2 | 88.1 | 7.9 |
| AD-953430.1 | 85.4 | 7.5 | 54.7 | 2.9 | 90.8 | 20.1 | 82.8 | 2.9 | 57.6 | 4.4 | 55.1 | 11.1 | 80.2 | 14.7 | 65.6 | 13.5 |
| AD-953485.1 | 66.8 | 2.1 | 54.9 | 3.8 | 84.8 | 6.5 | 90.0 | 2.2 | 39.0 | 8.2 | 42.3 | 5.6 | 66.0 | 8.7 | 95.6 | 22.6 |
| AD-953468.1 | 65.7 | 3.5 | 55.1 | 2.6 | 86.4 | 11.6 | 97.3 | 11.9 | 50.2 | 8.8 | 41.0 | 3.6 | 88.9 | 21.6 | 108.5 | 25.1 |
| AD-953444.1 | 63.2 | 2.2 | 55.3 | 3.8 | 81.6 | 15.3 | 87.3 | 9.0 | 55.0 | 5.1 | 76.5 | 12.6 | 108.8 | 22.7 | 70.4 | 18.1 |
| AD-953460.1 | 65.6 | 10.0 | 55.6 | 3.2 | 85.2 | 10.4 | 83.1 | 6.6 | 56.8 | 15.0 | 46.3 | 6.9 | 87.1 | 6.8 | 121.0 | 12.9 |
| AD-953539.1 | 67.0 | 8.5 | 56.1 | 11.5 | 62.2 | 2.9 | 97.3 | 4.3 | 47.1 | 5.3 | 30.5 | 6.1 | 65.5 | 15.9 | 89.6 | 10.6 |
| AD-953484.1 | 60.1 | 16.2 | 56.6 | 5.9 | 86.0 | 4.8 | 94.4 | 6.4 | 41.3 | 9.9 | 46.9 | 10.8 | 81.1 | 26.2 | 97.8 | 20.4 |
| AD-953457.1 | 69.0 | 26.0 | 57.8 | 5.5 | 79.7 | 22.5 | 78.0 | 8.4 | 96.5 | 61.4 | 42.8 | 3.1 | 85.0 | 11.8 | 84.4 | 28.0 |
| AD-953459.1 | 67.3 | 9.8 | 57.9 | 4.0 | 82.0 | 15.1 | 85.5 | 2.9 | 66.1 | 9.8 | 52.4 | 5.4 | 90.4 | 4.6 | 111.4 | 7.6 |
| AD-953437.1 | 74.6 | 5.0 | 58.6 | 4.4 | 87.7 | 20.7 | 84.6 | 6.4 | 53.5 | 5.2 | 70.2 | 20.0 | 89.8 | 7.7 | 77.7 | 21.8 |
| AD-953458.1 | 70.7 | 8.8 | 59.3 | 2.4 | 81.8 | 21.2 | 79.2 | 5.7 | 75.8 | 13.1 | 47.7 | 2.1 | 97.0 | 12.3 | 107.7 | 31.1 |
| AD-953453.1 | 69.9 | 3.5 | 59.5 | 4.3 | 74.0 | 17.2 | 84.4 | 11.6 | 61.1 | 9.9 | 59.0 | 5.7 | 89.6 | 5.5 | 88.0 | 27.3 |
| AD-953428.1 | 67.5 | 3.0 | 60.6 | 2.3 | 92.1 | 20.1 | 86.2 | 0.7 | 36.2 | 5.6 | 59.5 | 10.0 | 108.5 | 13.2 | 70.4 | 11.3 |
| AD-953501.1 | 77.3 | 7.8 | 60.9 | 5.8 | 91.7 | 5.6 | 100.8 | 7.2 | 67.9 | 9.6 | 61.3 | 14.9 | 80.5 | 24.9 | 73.2 | 5.7 |

TABLE 6C-continued

VEGF-A endogenous in vitro multi-dose screen with one set of exemplary human VEGF-A siRNAs

| | ARPE-19 | | | | | | | | hTERT RPE-1 | | | | | | | |
|---|---|---|---|---|---|---|---|---|---|---|---|---|---|---|---|---|
| Sample Name | 50 nM | StDev | 10 nM | StDev | 1 nM | StDev | 0.1 nM | StDev | 50 nM | StDev | 10 nM | StDev | 1 nM | StDev | 0.1 nM | StDev |
| AD-953482.1 | 76.7 | 1.5 | 61.5 | 3.4 | 94.6 | 8.4 | 100.1 | 5.4 | 71.8 | 9.0 | 53.7 | 8.6 | 115.9 | 9.7 | 101.9 | 20.8 |
| AD-953446.1 | 94.0 | 4.3 | 61.6 | 5.8 | 76.4 | 15.8 | 75.6 | 5.7 | 64.1 | 4.6 | 74.9 | 8.7 | 96.8 | 19.8 | 64.5 | 10.4 |
| AD-953488.1 | 65.7 | 3.3 | 61.8 | 3.9 | 81.2 | 15.8 | 95.9 | 9.8 | 81.3 | 5.3 | 60.2 | 18.5 | 123.3 | 46.3 | 76.4 | 23.7 |
| AD-953434.1 | 58.9 | 3.9 | 61.9 | 3.1 | 91.4 | 17.9 | 94.1 | 10.6 | 49.7 | 5.3 | 92.6 | 15.2 | 123.1 | 12.0 | 71.5 | 10.1 |
| AD-953546.1 | 49.9 | 1.9 | 63.3 | 14.5 | 59.7 | 4.4 | 80.8 | 2.1 | 48.2 | 2.7 | 41.6 | 12.9 | 72.9 | 5.4 | 72.9 | 8.7 |
| AD-953529.1 | 59.0 | 3.6 | 64.8 | 9.9 | 63.9 | 2.4 | 78.3 | 1.9 | 61.5 | 5.7 | 48.5 | 7.4 | 117.3 | 20.3 | 91.1 | 15.1 |
| AD-953433.1 | 95.2 | 10.7 | 64.8 | 6.3 | 78.5 | 16.2 | 82.5 | 2.6 | 69.0 | 5.2 | 109.4 | 7.2 | 107.4 | 13.2 | 98.9 | 35.0 |
| AD-953456.1 | 68.1 | 8.4 | 64.9 | 4.7 | 95.7 | 22.5 | 94.1 | 2.7 | 86.8 | 14.7 | 56.3 | 7.0 | 89.1 | 10.7 | 89.1 | 12.9 |
| AD-953435.1 | 69.8 | 3.4 | 65.1 | 4.1 | 88.1 | 18.6 | 92.9 | 4.8 | 57.5 | 9.2 | 75.3 | 5.7 | 104.3 | 2.4 | 71.9 | 13.2 |
| AD-953438.1 | 70.2 | 4.8 | 66.4 | 5.8 | 105.5 | 19.6 | 88.2 | 3.9 | 46.0 | 7.7 | 61.7 | 19.7 | 90.1 | 14.9 | 71.7 | 16.9 |
| AD-953452.1 | 80.0 | 5.5 | 66.9 | 6.7 | 96.6 | 21.5 | 89.5 | 10.8 | 53.2 | 3.6 | 46.9 | 7.7 | 94.3 | 14.7 | 104.6 | 25.8 |
| AD-953489.1 | 86.9 | 6.5 | 69.3 | 5.5 | 89.1 | 10.0 | 97.0 | 8.7 | 82.0 | 16.1 | 80.6 | 15.6 | 125.9 | 15.7 | 77.4 | 19.4 |
| AD-953445.1 | 104.1 | 7.0 | 71.5 | 3.4 | 88.6 | 21.2 | 85.2 | 10.1 | 68.1 | 3.0 | 91.0 | 8.8 | 103.1 | 9.2 | 80.5 | 32.1 |
| AD-953432.1 | 62.6 | 4.1 | 71.6 | 4.0 | 106.7 | 23.0 | 109.1 | 13.6 | 38.2 | 5.3 | 69.3 | 6.0 | 104.2 | 19.0 | 88.8 | 34.4 |
| AD-953509.1 | 96.2 | 8.8 | 71.8 | 2.2 | 68.5 | 36.5 | 93.1 | 7.2 | 71.0 | 33.3 | 70.4 | 7.3 | 77.7 | 11.3 | 65.4 | 12.1 |
| AD-953490.1 | 89.4 | 6.4 | 72.2 | 2.5 | 85.2 | 6.8 | 95.5 | 8.7 | 109.5 | 9.8 | 68.7 | 8.2 | 106.9 | 14.9 | 74.4 | 6.7 |
| AD-953448.1 | 67.8 | 3.6 | 72.7 | 5.1 | 101.5 | 20.3 | 94.8 | 9.3 | 76.1 | 25.3 | 61.8 | 6.4 | 110.6 | 35.5 | 79.5 | 29.6 |
| AD-953450.1 | 78.6 | 2.3 | 72.8 | 5.4 | 96.9 | 14.3 | 91.0 | 7.6 | 72.1 | 7.7 | 53.3 | 4.3 | 120.8 | 11.3 | 117.2 | 41.1 |
| AD-953443.1 | 96.4 | 8.9 | 73.3 | 2.2 | 96.4 | 22.9 | 90.7 | 4.5 | 60.8 | 3.2 | 100.7 | 16.4 | 95.8 | 18.2 | 83.7 | 14.5 |
| AD-953525.1 | 81.5 | 6.2 | 73.4 | 4.5 | 79.8 | 16.8 | 90.4 | 2.8 | 53.0 | 4.5 | 69.3 | 8.5 | 86.0 | 16.0 | 90.0 | 8.6 |
| AD-953523.1 | 74.3 | 4.9 | 73.4 | 8.8 | 88.1 | 6.8 | 100.9 | 5.1 | 58.3 | 15.3 | 91.1 | 6.6 | 116.2 | 14.1 | 78.2 | 3.5 |
| AD-953507.1 | 78.1 | 8.2 | 73.7 | 5.3 | 86.3 | 6.8 | 98.8 | 5.4 | 51.1 | 14.2 | 64.7 | 6.5 | 104.2 | 32.5 | 75.3 | 23.7 |
| AD-953451.1 | 87.6 | 7.6 | 74.0 | 8.2 | 92.4 | 16.6 | 90.3 | 3.1 | 95.8 | 23.0 | 56.1 | 5.2 | 112.4 | 8.5 | 110.3 | 6.9 |
| AD-953429.1 | 91.2 | 8.9 | 74.2 | 4.9 | 99.8 | 24.4 | 93.0 | 7.0 | 57.0 | 9.1 | 66.7 | 10.2 | 99.6 | 11.7 | 79.4 | 16.7 |
| AD-953469.1 | 84.5 | 11.2 | 74.6 | 5.1 | 109.2 | 18.8 | 95.6 | 5.9 | 75.1 | 4.5 | 62.7 | 8.0 | 88.1 | 7.8 | 117.5 | 17.4 |
| AD-953463.1 | 88.7 | 17.1 | 74.8 | 4.8 | 101.9 | 20.8 | 99.2 | 5.1 | 70.1 | 8.6 | 75.6 | 20.8 | 80.2 | 25.5 | 88.4 | 11.1 |
| AD-953454.1 | 106.1 | 7.0 | 74.9 | 6.7 | 95.6 | 26.8 | 86.4 | 9.1 | 76.3 | 20.1 | 67.7 | 21.9 | 95.9 | 14.3 | 84.0 | 35.8 |
| AD-953455.1 | 99.0 | 14.1 | 75.0 | 5.4 | 101.7 | 25.0 | 98.1 | 5.5 | 81.5 | 17.4 | 72.9 | 19.3 | 76.3 | 14.6 | 69.1 | 15.5 |
| AD-953511.1 | 83.7 | 3.8 | 75.3 | 6.2 | 86.7 | 5.4 | 100.7 | 8.8 | 76.0 | 31.8 | 71.6 | 10.7 | 131.4 | 22.1 | 94.7 | 13.1 |
| AD-953447.1 | 95.2 | 8.5 | 75.6 | 4.2 | 101.4 | 18.3 | 89.6 | 4.2 | 67.5 | 9.6 | 73.0 | 10.4 | 75.9 | 14.6 | 76.1 | 16.4 |
| AD-953424.1 | 78.8 | 3.7 | 75.8 | 8.2 | 96.4 | 26.2 | 99.3 | 5.8 | 56.2 | 9.0 | 98.3 | 31.6 | 112.0 | 18.9 | 68.1 | 16.5 |
| AD-953506.1 | 82.9 | 3.4 | 76.4 | 3.9 | 94.6 | 10.2 | 98.2 | 7.0 | 54.4 | 7.9 | 80.4 | 12.3 | 104.5 | 27.0 | 85.1 | 2.6 |
| AD-953537.1 | 71.6 | 3.2 | 76.4 | 16.4 | 81.7 | 10.1 | 93.7 | 6.6 | 61.5 | 11.6 | 52.7 | 14.9 | 104.7 | 9.9 | 102.3 | 8.2 |
| AD-953477.1 | 104.2 | 11.7 | 76.5 | 4.8 | 93.7 | 6.9 | 90.6 | 5.6 | 77.5 | 20.8 | 62.6 | 12.8 | 75.1 | 22.1 | 105.4 | 29.2 |
| AD-953479.1 | 90.5 | 8.9 | 77.0 | 10.7 | 99.9 | 16.6 | 109.0 | 9.6 | 99.6 | 9.7 | 74.8 | 9.6 | 116.9 | 25.5 | 104.0 | 21.8 |
| AD-953439.1 | 102.3 | 7.6 | 77.2 | 4.5 | 100.8 | 26.6 | 97.8 | 5.7 | 68.0 | 8.2 | 80.5 | 24.1 | 72.4 | 18.5 | 66.2 | 17.0 |
| AD-953431.1 | 86.4 | 7.7 | 77.5 | 7.5 | 116.2 | 20.7 | 93.5 | 15.3 | 52.4 | 2.4 | 45.7 | 9.6 | 71.9 | 3.0 | 62.8 | 10.1 |
| AD-953442.1 | 89.4 | 4.5 | 78.2 | 5.5 | 99.8 | 20.9 | 90.2 | 7.4 | 69.0 | 13.2 | 95.2 | 19.1 | 119.3 | 10.1 | 77.5 | 19.9 |
| AD-953449.1 | 81.5 | 5.9 | 78.3 | 5.3 | 95.1 | 23.3 | 90.1 | 7.6 | 82.6 | 15.4 | 72.5 | 14.2 | 113.9 | 14.0 | 93.2 | 12.8 |
| AD-953510.1 | 94.1 | 6.6 | 78.6 | 6.2 | 85.2 | 8.5 | 88.6 | 4.2 | 62.7 | 11.1 | 74.3 | 3.6 | 73.1 | 12.6 | 30.5 | 6.0 |
| AD-953514.1 | 98.5 | 10.4 | 78.8 | 9.3 | 95.6 | 4.4 | 89.4 | 4.6 | 80.1 | 19.3 | 89.0 | 3.5 | 118.7 | 18.7 | 94.8 | 19.4 |
| AD-953508.1 | 96.9 | 7.3 | 78.9 | 7.1 | 96.5 | 24.7 | 98.7 | 8.7 | 68.5 | 15.8 | 76.9 | 13.9 | 94.3 | 15.5 | 75.2 | 11.5 |
| AD-953531.1 | 70.3 | 2.0 | 80.7 | 17.0 | 82.8 | 4.0 | 90.6 | 4.3 | 80.9 | 15.6 | 62.5 | 12.3 | 98.0 | 12.4 | 73.4 | 7.0 |
| AD-953427.1 | 105.8 | 12.1 | 81.1 | 4.6 | 91.0 | 25.6 | 90.0 | 3.7 | 65.3 | 3.7 | 100.2 | 12.6 | 109.0 | 17.8 | 66.6 | 15.2 |
| AD-953512.1 | 94.6 | 2.1 | 83.9 | 4.5 | 91.3 | 10.6 | 96.7 | 7.7 | 84.8 | 13.3 | 84.0 | 11.0 | 129.5 | 10.3 | 88.3 | 15.8 |
| AD-953533.1 | 102.2 | 9.2 | 85.2 | 21.1 | 82.6 | 15.3 | 108.6 | 13.4 | 85.5 | 12.3 | 66.0 | 13.3 | 89.2 | 14.1 | 73.0 | 12.3 |
| AD-953464.1 | 76.9 | 3.8 | 86.1 | 6.5 | 104.6 | 21.8 | 99.9 | 10.3 | 110.5 | 10.6 | 74.5 | 5.0 | 87.7 | 18.7 | 111.9 | 6.1 |
| AD-953542.1 | 51.8 | 2.5 | 86.3 | 24.8 | 66.0 | 11.3 | 98.1 | 17.1 | 54.8 | 9.9 | 69.8 | 2.3 | 95.8 | 13.9 | 104.4 | 4.4 |
| AD-953426.1 | 102.2 | 10.9 | 87.8 | 5.7 | 103.4 | 24.0 | 97.1 | 2.0 | 67.3 | 5.4 | 120.7 | 18.0 | 117.5 | 16.3 | 74.5 | 27.0 |
| AD-953515.1 | 92.6 | 5.7 | 88.4 | 6.2 | 84.6 | 21.4 | 98.2 | 9.4 | 95.5 | 21.8 | 84.9 | 10.3 | 124.9 | 28.4 | 86.9 | 4.2 |
| AD-953487.1 | 99.3 | 9.8 | 88.7 | 12.4 | 90.1 | 13.7 | 95.1 | 3.2 | 106.9 | 17.5 | 88.1 | 5.6 | 118.9 | 35.4 | 57.1 | 14.7 |
| AD-953521.1 | 104.2 | 20.4 | 89.0 | 1.5 | 109.1 | 13.9 | 96.2 | 9.4 | 76.6 | 12.8 | 89.5 | 10.4 | 131.6 | 23.9 | 81.8 | 10.5 |
| AD-953425.1 | 81.5 | 13.2 | 90.2 | 4.0 | 99.5 | 24.2 | 94.8 | 6.2 | 63.6 | 4.3 | 114.5 | 27.3 | 142.3 | 60.9 | 75.3 | 25.7 |
| AD-953536.1 | 75.4 | 13.1 | 90.2 | 23.7 | 86.6 | 4.9 | 98.4 | 8.1 | 75.0 | 8.5 | 58.1 | 20.2 | 120.5 | 32.6 | 96.6 | 11.8 |
| AD-953465.1 | 97.2 | 10.0 | 91.4 | 6.6 | 114.1 | 30.7 | 91.7 | 5.7 | 92.3 | 7.4 | 78.6 | 6.8 | 99.2 | 29.1 | 131.0 | 23.9 |
| AD-953552.1 | 82.6 | 7.9 | 92.5 | 22.4 | 88.2 | 4.8 | 102.3 | 6.4 | 86.4 | 15.8 | 85.2 | 16.6 | 55.7 | 16.7 | 89.0 | 12.2 |
| AD-953528.1 | 87.5 | 15.0 | 93.5 | 11.1 | 83.9 | 8.8 | 85.7 | 4.5 | 111.2 | 40.7 | 69.5 | 16.7 | 142.9 | 10.9 | 103.3 | 8.0 |
| AD-953519.1 | 107.5 | 2.3 | 93.5 | 4.8 | 96.1 | 5.2 | 91.0 | 3.3 | 92.7 | 9.0 | 113.7 | 6.9 | 146.7 | 24.6 | 121.8 | 38.4 |
| AD-953486.1 | 105.6 | 3.7 | 94.2 | 5.6 | 103.9 | 8.6 | 96.7 | 6.1 | 75.6 | 1.5 | 106.1 | 34.1 | 83.7 | 17.1 | 78.1 | 21.7 |
| AD-953522.1 | 97.7 | 9.0 | 94.3 | 4.2 | 100.0 | 16.6 | 99.0 | 8.4 | 98.8 | 21.3 | 87.2 | 16.4 | 106.8 | 15.9 | 84.1 | 7.4 |
| AD-953530.1 | 76.4 | 4.7 | 94.3 | 19.0 | 90.2 | 8.9 | 93.8 | 9.9 | 72.4 | 16.7 | 67.0 | 12.1 | 93.5 | 11.7 | 93.3 | 11.8 |
| AD-953513.1 | 104.1 | 3.5 | 95.5 | 7.9 | 92.8 | 9.4 | 103.5 | 10.8 | 90.2 | 28.8 | 76.6 | 6.8 | 144.6 | 24.5 | 101.7 | 12.6 |
| AD-953441.1 | 97.5 | 8.0 | 95.5 | 5.0 | 114.8 | 18.2 | 106.5 | 8.7 | 63.8 | 4.1 | 105.6 | 4.8 | 125.4 | 24.0 | 80.4 | 27.5 |
| AD-953440.1 | 87.8 | 6.4 | 95.5 | 12.2 | 112.8 | 26.2 | 97.9 | 1.2 | 83.3 | 7.9 | 106.5 | 13.4 | 118.0 | 10.0 | 75.4 | 27.2 |
| AD-953518.1 | 91.0 | 4.9 | 96.1 | 3.4 | 99.6 | 2.8 | 93.9 | 12.4 | 96.6 | 24.0 | 91.4 | 16.4 | 126.5 | 19.7 | 108.8 | 16.1 |
| AD-953520.1 | 92.8 | 7.3 | 96.1 | 3.8 | 99.9 | 18.5 | 99.9 | 7.3 | 91.8 | 18.0 | 89.3 | 13.6 | 140.3 | 21.3 | 96.0 | 17.7 |
| AD-953532.1 | 92.3 | 7.2 | 99.5 | 16.4 | 96.9 | 11.9 | 93.0 | 4.9 | 87.9 | 12.7 | 67.9 | 9.0 | 89.9 | 24.8 | 70.6 | 13.2 |
| AD-953548.1 | 85.7 | 8.0 | 100.5 | 20.0 | 89.8 | 7.6 | 99.4 | 7.1 | 58.8 | 8.9 | 67.7 | 24.6 | 80.1 | 6.0 | 78.0 | 9.0 |
| AD-953527.1 | 91.5 | 2.8 | 101.9 | 15.1 | 92.3 | 14.5 | 102.6 | 4.5 | 113.8 | 41.2 | 69.2 | 18.2 | 132.4 | 36.0 | 108.0 | 10.6 |
| AD-953551.1 | 91.4 | 4.5 | 103.0 | 24.3 | 94.8 | 1.1 | 101.1 | 5.4 | 130.4 | 41.4 | 78.2 | 20.9 | 65.8 | 13.8 | 102.2 | 11.8 |
| AD-953553.1 | 93.9 | 1.2 | 103.2 | 25.6 | 93.3 | 6.6 | 100.2 | 4.2 | 88.5 | 10.1 | 93.5 | 20.0 | 65.1 | 15.8 | 93.0 | 13.6 |
| AD-953547.1 | 89.1 | 3.6 | 104.0 | 18.7 | 94.3 | 7.6 | 97.6 | 3.0 | 65.0 | 6.4 | 60.7 | 16.1 | 85.8 | 9.7 | 86.6 | 8.6 |
| AD-953526.1 | 88.7 | 5.7 | 110.0 | 23.2 | 95.7 | 3.2 | 100.8 | 12.4 | 117.9 | 52.9 | 75.4 | 16.8 | 115.9 | 12.6 | 102.1 | 10.6 |

TABLE 6C-continued

| VEGF-A endogenous in vitro multi-dose screen with one set of exemplary human VEGF-A siRNAs | | | | | | | | | | | | | | | | |
|---|---|---|---|---|---|---|---|---|---|---|---|---|---|---|---|---|
| | ARPE-19 | | | | | | | | hTERT RPE-1 | | | | | | | |
| Sample Name | 50 nM | StDev | 10 nM | StDev | 1 nM | StDev | 0.1 nM | StDev | 50 nM | StDev | 10 nM | StDev | 1 nM | StDev | 0.1 nM | StDev |
| AD-953549.1 | 94.4 | 8.8 | 113.8 | 25.9 | 70.6 | 23.4 | 106.6 | 12.7 | 54.1 | 8.2 | 55.2 | 18.7 | 85.6 | 31.6 | 81.4 | 15.2 |
| AD-953534.1 | 102.5 | 8.5 | 117.9 | 27.3 | 95.0 | 14.1 | 79.9 | 5.5 | 137.0 | 23.5 | 81.4 | 20.8 | 141.1 | 19.1 | 103.4 | 12.1 |
| AD-953543.1 | 99.3 | 3.5 | 118.0 | 17.9 | 89.7 | 4.0 | 96.9 | 4.6 | 111.5 | 41.1 | 99.7 | 30.4 | 123.8 | 17.6 | 104.4 | 15.0 |
| AD-953550.1 | 96.0 | 5.8 | 121.6 | 19.6 | 98.9 | 12.3 | 99.0 | 9.0 | 119.6 | 20.5 | 101.5 | 20.0 | 52.7 | 10.9 | 93.6 | 13.1 |

The results of the multi-dose screen in African green monkey kidney cells (Cos-7) transfected with Cynomolgus monkey VEGF-A with a set of exemplary rat VEGF-A siRNAs are shown in Table 7A (correspond to siRNAs in Table 5A and Table 5B). The results of the multi-dose screen in Cos-7 cells transfected with mouse VEGF-A with a set of exemplary rat VEGF-A siRNAs are shown in Table 7B (correspond to siRNAs in Table 5A and Table 5B). The multi-dose experiments were performed at 10 nM, 1 nM, and 0.1 nM final duplex concentrations and the data are expressed as percent message remaining relative to non-targeting control.

TABLE 7A

| Cynomolgus monkey VEGF-A in vitro multi-dose screen with one set of exemplary rat VEGF-A siRNAs | | | | |
|---|---|---|---|---|
| Duplex Name | Average | StDev | Dose | Dose Unit |
| AD-579911.1 | 21.79 | 0.50 | 10 | nM |
| AD-579912.1 | 20.38 | 3.81 | 10 | nM |
| AD-579913.1 | 16.71 | 8.39 | 10 | nM |
| AD-579914.1 | 45.98 | 4.11 | 10 | nM |
| AD-579915.1 | 35.03 | 7.59 | 10 | nM |
| AD-579916.1 | 12.14 | 1.83 | 10 | nM |
| AD-579917.1 | 25.40 | 3.24 | 10 | nM |
| AD-579918.1 | 26.56 | 2.53 | 10 | nM |
| AD-579919.1 | 10.58 | 2.15 | 10 | nM |
| AD-579921.1 | 12.64 | 2.73 | 10 | nM |
| AD-579922.1 | 13.78 | 0.77 | 10 | nM |
| AD-579923.1 | 17.37 | 1.62 | 10 | nM |
| AD-579924.1 | 49.49 | 4.24 | 10 | nM |
| AD-579925.1 | 10.62 | 1.31 | 10 | nM |
| AD-579926.1 | 13.23 | 2.83 | 10 | nM |
| AD-579927.1 | 25.34 | 3.60 | 10 | nM |
| AD-579929.1 | 26.33 | 1.74 | 10 | nM |
| AD-579930.1 | 81.28 | 12.54 | 10 | nM |
| AD-579931.1 | 41.52 | 7.38 | 10 | nM |
| AD-579932.1 | 12.14 | 3.92 | 10 | nM |
| AD-579933.1 | 30.75 | 3.29 | 10 | nM |
| AD-579934.1 | 186.16 | 29.32 | 10 | nM |
| AD-579935.1 | 67.60 | 6.57 | 10 | nM |
| AD-579936.1 | 81.10 | 20.59 | 10 | nM |
| AD-579937.1 | 25.95 | 3.27 | 10 | nM |
| AD-579938.1 | 60.65 | 8.90 | 10 | nM |
| AD-579939.1 | 72.01 | 14.89 | 10 | nM |
| AD-579940.1 | 96.52 | 8.39 | 10 | nM |
| AD-579941.1 | 106.40 | 13.04 | 10 | nM |
| AD-579942.1 | 61.87 | 12.12 | 10 | nM |
| AD-579943.1 | 12.46 | 4.75 | 10 | nM |
| AD-579944.1 | 28.49 | 4.13 | 10 | nM |
| AD-579945.1 | 70.53 | 8.74 | 10 | nM |
| AD-579946.1 | 24.47 | 6.19 | 10 | nM |
| AD-579947.1 | 68.58 | 4.38 | 10 | nM |
| AD-579948.1 | 77.63 | 5.92 | 10 | nM |
| AD-579949.1 | 96.51 | 8.80 | 10 | nM |
| AD-579950.1 | 230.10 | 21.51 | 10 | nM |
| AD-579951.1 | 66.36 | 16.79 | 10 | nM |
| AD-579953.1 | 18.42 | 5.42 | 10 | nM |
| AD-579954.1 | 21.24 | 4.31 | 10 | nM |
| AD-579955.1 | 69.32 | 6.99 | 10 | nM |

TABLE 7A-continued

| Cynomolgus monkey VEGF-A in vitro multi-dose screen with one set of exemplary rat VEGF-A siRNAs | | | | |
|---|---|---|---|---|
| Duplex Name | Average | StDev | Dose | Dose Unit |
| AD-579956.1 | 99.49 | 25.18 | 10 | nM |
| AD-579957.1 | 49.05 | 14.80 | 10 | nM |
| AD-579958.1 | 88.74 | 8.73 | 10 | nM |
| AD-579959.1 | 100.41 | 9.53 | 10 | nM |
| AD-579960.1 | 39.31 | 3.68 | 10 | nM |
| AD-579961.1 | 96.81 | 13.20 | 10 | nM |
| AD-579962.1 | 53.43 | 6.50 | 10 | nM |
| AD-579963.1 | 21.24 | 3.25 | 10 | nM |
| AD-579964.1 | 17.83 | 7.13 | 10 | nM |
| AD-579965.1 | 92.27 | 14.22 | 10 | nM |
| AD-579966.1 | 88.97 | 9.79 | 10 | nM |
| AD-579967.1 | 47.49 | 7.04 | 10 | nM |
| AD-579968.1 | 76.96 | 8.70 | 10 | nM |
| AD-579969.1 | 90.81 | 8.30 | 10 | nM |
| AD-579970.1 | 104.42 | 26.45 | 10 | nM |
| AD-579971.1 | 14.37 | 6.47 | 10 | nM |
| AD-579972.1 | 57.43 | 2.61 | 10 | nM |
| AD-579973.1 | 103.95 | 3.97 | 10 | nM |
| AD-579974.1 | 81.04 | 3.86 | 10 | nM |
| AD-579975.1 | 33.28 | 7.01 | 10 | nM |
| AD-579976.1 | 79.49 | 2.88 | 10 | nM |
| AD-579977.1 | 80.67 | 6.29 | 10 | nM |
| AD-579978.1 | 66.72 | 3.59 | 10 | nM |
| AD-579979.1 | 92.24 | 3.77 | 10 | nM |
| AD-579980.1 | 25.30 | 3.08 | 10 | nM |
| AD-579981.1 | 48.69 | 11.03 | 10 | nM |
| AD-579982.1 | 49.50 | 15.70 | 10 | nM |
| AD-579983.1 | 10.78 | 4.14 | 10 | nM |
| AD-579984.1 | 16.79 | 1.90 | 10 | nM |
| AD-579985.1 | 11.35 | 0.96 | 10 | nM |
| AD-579986.1 | 33.51 | 4.42 | 10 | nM |
| AD-579987.1 | 26.04 | 3.89 | 10 | nM |
| AD-579988.1 | 30.67 | 3.01 | 10 | nM |
| AD-579989.1 | 33.51 | 6.72 | 10 | nM |
| AD-579990.1 | 72.51 | 4.50 | 10 | nM |
| AD-579992.1 | 61.70 | 6.74 | 10 | nM |
| AD-579993.1 | 92.69 | 10.40 | 10 | nM |
| AD-579995.1 | 30.40 | 4.51 | 10 | nM |
| AD-579996.1 | 94.02 | 11.86 | 10 | nM |
| AD-579997.1 | 34.79 | 5.90 | 10 | nM |
| AD-579998.1 | 31.10 | 6.52 | 10 | nM |
| AD-579999.1 | 137.05 | 8.03 | 10 | nM |
| AD-580000.1 | 162.84 | 26.73 | 10 | nM |
| AD-580001.1 | 125.00 | 7.31 | 10 | nM |
| AD-580002.1 | 186.90 | 14.34 | 10 | nM |
| AD-579911.1 | 34.63 | 4.90 | 1 | nM |
| AD-579912.1 | 31.99 | 3.89 | 1 | nM |
| AD-579913.1 | 36.38 | 2.19 | 1 | nM |
| AD-579914.1 | 47.66 | 5.91 | 1 | nM |
| AD-579915.1 | 33.92 | 0.98 | 1 | nM |
| AD-579916.1 | 25.64 | 5.85 | 1 | nM |
| AD-579917.1 | 38.41 | 8.43 | 1 | nM |
| AD-579918.1 | 37.12 | 9.78 | 1 | nM |
| AD-579919.1 | 13.33 | 2.62 | 1 | nM |
| AD-579921.1 | 24.01 | 3.06 | 1 | nM |
| AD-579922.1 | 21.65 | 1.29 | 1 | nM |
| AD-579923.1 | 32.00 | 1.21 | 1 | nM |

TABLE 7A-continued

Cynomolgus monkey VEGF-A in vitro multi-dose screen with one set of exemplary rat VEGF-A siRNAs

| Duplex Name | Average | StDev | Dose | Dose Unit |
|---|---|---|---|---|
| AD-579924.1 | 74.46 | 5.43 | 1 | nM |
| AD-579925.1 | 27.19 | 4.59 | 1 | nM |
| AD-579926.1 | 23.17 | 2.37 | 1 | nM |
| AD-579927.1 | 44.62 | 10.37 | 1 | nM |
| AD-579929.1 | 32.40 | 3.90 | 1 | nM |
| AD-579930.1 | 82.85 | 10.31 | 1 | nM |
| AD-579931.1 | 53.35 | 11.21 | 1 | nM |
| AD-579932.1 | 25.97 | 4.61 | 1 | nM |
| AD-579933.1 | 64.26 | 11.63 | 1 | nM |
| AD-579934.1 | 110.08 | 21.79 | 1 | nM |
| AD-579935.1 | 75.45 | 3.94 | 1 | nM |
| AD-579936.1 | 88.42 | 7.56 | 1 | nM |
| AD-579937.1 | 25.63 | 2.94 | 1 | nM |
| AD-579938.1 | 67.82 | 2.00 | 1 | nM |
| AD-579939.1 | 69.81 | 7.16 | 1 | nM |
| AD-579940.1 | 99.17 | 5.18 | 1 | nM |
| AD-579941.1 | 108.34 | 7.84 | 1 | nM |
| AD-579942.1 | 70.36 | 12.47 | 1 | nM |
| AD-579943.1 | 26.50 | 3.47 | 1 | nM |
| AD-579944.1 | 35.87 | 5.32 | 1 | nM |
| AD-579945.1 | 82.17 | 15.84 | 1 | nM |
| AD-579946.1 | 28.27 | 2.22 | 1 | nM |
| AD-579947.1 | 77.96 | 16.94 | 1 | nM |
| AD-579948.1 | 79.99 | 3.99 | 1 | nM |
| AD-579949.1 | 108.10 | 12.09 | 1 | nM |
| AD-579950.1 | 134.00 | 16.20 | 1 | nM |
| AD-579951.1 | 66.05 | 9.65 | 1 | nM |
| AD-579953.1 | 27.50 | 5.68 | 1 | nM |
| AD-579954.1 | 20.74 | 3.51 | 1 | nM |
| AD-579955.1 | 74.44 | 17.09 | 1 | nM |
| AD-579956.1 | 113.45 | 9.64 | 1 | nM |
| AD-579957.1 | 73.78 | 1.80 | 1 | nM |
| AD-579958.1 | 94.21 | 11.02 | 1 | nM |
| AD-579959.1 | 95.73 | 17.31 | 1 | nM |
| AD-579960.1 | 37.92 | 6.36 | 1 | nM |
| AD-579961.1 | 95.86 | 5.08 | 1 | nM |
| AD-579962.1 | 79.16 | 6.58 | 1 | nM |
| AD-579963.1 | 22.85 | 4.33 | 1 | nM |
| AD-579964.1 | 23.33 | 2.88 | 1 | nM |
| AD-579965.1 | 96.34 | 24.13 | 1 | nM |
| AD-579966.1 | 85.86 | 12.83 | 1 | nM |
| AD-579967.1 | 59.03 | 6.42 | 1 | nM |
| AD-579968.1 | 72.33 | 7.43 | 1 | nM |
| AD-579969.1 | 86.79 | 3.22 | 1 | nM |
| AD-579970.1 | 100.80 | 8.64 | 1 | nM |
| AD-579971.1 | 12.62 | 2.38 | 1 | nM |
| AD-579972.1 | 52.06 | 7.34 | 1 | nM |
| AD-579973.1 | 96.38 | 18.09 | 1 | nM |
| AD-579974.1 | 90.54 | 6.77 | 1 | nM |
| AD-579975.1 | 54.49 | 4.18 | 1 | nM |
| AD-579976.1 | 83.49 | 18.12 | 1 | nM |
| AD-579977.1 | 86.21 | 10.51 | 1 | nM |
| AD-579978.1 | 73.79 | 28.62 | 1 | nM |
| AD-579979.1 | 102.91 | 17.40 | 1 | nM |
| AD-579980.1 | 22.61 | 1.11 | 1 | nM |
| AD-579981.1 | 62.79 | 8.71 | 1 | nM |
| AD-579982.1 | 57.63 | 7.73 | 1 | nM |
| AD-579983.1 | 17.63 | 2.73 | 1 | nM |
| AD-579984.1 | 25.44 | 1.54 | 1 | nM |
| AD-579985.1 | 20.01 | 6.16 | 1 | nM |
| AD-579986.1 | 45.92 | 2.90 | 1 | nM |
| AD-579987.1 | 35.60 | 5.94 | 1 | nM |
| AD-579988.1 | 41.30 | 3.29 | 1 | nM |
| AD-579989.1 | 35.25 | 1.19 | 1 | nM |
| AD-579990.1 | 75.79 | 12.51 | 1 | nM |
| AD-579992.1 | 70.19 | 10.59 | 1 | nM |
| AD-579993.1 | 81.86 | 8.27 | 1 | nM |
| AD-579995.1 | 32.90 | 4.47 | 1 | nM |
| AD-579996.1 | 91.93 | 9.06 | 1 | nM |
| AD-579997.1 | 54.91 | 2.41 | 1 | nM |
| AD-579998.1 | 35.62 | 5.31 | 1 | nM |
| AD-579999.1 | 105.80 | 11.56 | 1 | nM |
| AD-580000.1 | 151.28 | 8.84 | 1 | nM |
| AD-580001.1 | 117.48 | 17.60 | 1 | nM |

TABLE 7A-continued

Cynomolgus monkey VEGF-A in vitro multi-dose screen with one set of exemplary rat VEGF-A siRNAs

| Duplex Name | Average | StDev | Dose | Dose Unit |
|---|---|---|---|---|
| AD-580002.1 | 148.64 | 32.44 | 1 | nM |
| AD-579911.1 | 60.59 | 5.99 | 0.1 | nM |
| AD-579912.1 | 58.68 | 4.12 | 0.1 | nM |
| AD-579913.1 | 64.23 | 5.02 | 0.1 | nM |
| AD-579914.1 | 74.48 | 8.13 | 0.1 | nM |
| AD-579915.1 | 56.70 | 3.72 | 0.1 | nM |
| AD-579916.1 | 41.93 | 5.43 | 0.1 | nM |
| AD-579917.1 | 78.90 | 9.40 | 0.1 | nM |
| AD-579918.1 | 66.57 | 10.31 | 0.1 | nM |
| AD-579919.1 | 29.08 | 2.79 | 0.1 | nM |
| AD-579921.1 | 59.28 | 4.60 | 0.1 | nM |
| AD-579922.1 | 56.67 | 8.89 | 0.1 | nM |
| AD-579923.1 | 75.33 | 12.81 | 0.1 | nM |
| AD-579924.1 | 100.79 | 20.47 | 0.1 | nM |
| AD-579925.1 | 72.05 | 13.30 | 0.1 | nM |
| AD-579926.1 | 63.98 | 8.75 | 0.1 | nM |
| AD-579927.1 | 78.12 | 11.58 | 0.1 | nM |
| AD-579929.1 | 67.27 | 19.11 | 0.1 | nM |
| AD-579930.1 | 96.27 | 17.88 | 0.1 | nM |
| AD-579931.1 | 75.81 | 15.09 | 0.1 | nM |
| AD-579932.1 | 61.06 | 2.54 | 0.1 | nM |
| AD-579933.1 | 85.95 | 8.05 | 0.1 | nM |
| AD-579934.1 | 100.61 | 4.77 | 0.1 | nM |
| AD-579935.1 | 88.00 | 10.57 | 0.1 | nM |
| AD-579936.1 | 88.13 | 9.64 | 0.1 | nM |
| AD-579937.1 | 55.87 | 4.99 | 0.1 | nM |
| AD-579938.1 | 90.35 | 12.54 | 0.1 | nM |
| AD-579939.1 | 100.22 | 5.50 | 0.1 | nM |
| AD-579940.1 | 117.60 | 9.00 | 0.1 | nM |
| AD-579941.1 | 100.53 | 13.72 | 0.1 | nM |
| AD-579942.1 | 100.72 | 12.00 | 0.1 | nM |
| AD-579943.1 | 41.23 | 3.38 | 0.1 | nM |
| AD-579944.1 | 73.67 | 9.65 | 0.1 | nM |
| AD-579945.1 | 101.57 | 13.70 | 0.1 | nM |
| AD-579946.1 | 42.00 | 1.99 | 0.1 | nM |
| AD-579947.1 | 88.52 | 29.57 | 0.1 | nM |
| AD-579948.1 | 94.78 | 13.34 | 0.1 | nM |
| AD-579949.1 | 106.50 | 4.63 | 0.1 | nM |
| AD-579950.1 | 112.38 | 10.41 | 0.1 | nM |
| AD-579951.1 | 81.88 | 7.61 | 0.1 | nM |
| AD-579953.1 | 65.43 | 5.35 | 0.1 | nM |
| AD-579954.1 | 29.05 | 3.98 | 0.1 | nM |
| AD-579955.1 | 101.64 | 8.13 | 0.1 | nM |
| AD-579956.1 | 109.12 | 12.60 | 0.1 | nM |
| AD-579957.1 | 95.19 | 6.14 | 0.1 | nM |
| AD-579958.1 | 99.02 | 14.55 | 0.1 | nM |
| AD-579959.1 | 96.08 | 7.16 | 0.1 | nM |
| AD-579960.1 | 65.43 | 20.16 | 0.1 | nM |
| AD-579961.1 | 89.02 | 11.37 | 0.1 | nM |
| AD-579962.1 | 107.63 | 11.06 | 0.1 | nM |
| AD-579963.1 | 54.55 | 6.58 | 0.1 | nM |
| AD-579964.1 | 37.19 | 5.60 | 0.1 | nM |
| AD-579965.1 | 93.32 | 9.87 | 0.1 | nM |
| AD-579966.1 | 93.21 | 13.54 | 0.1 | nM |
| AD-579967.1 | 78.97 | 5.07 | 0.1 | nM |
| AD-579968.1 | 83.13 | 8.48 | 0.1 | nM |
| AD-579969.1 | 97.62 | 21.40 | 0.1 | nM |
| AD-579970.1 | 102.49 | 8.36 | 0.1 | nM |
| AD-579971.1 | 22.84 | 3.85 | 0.1 | nM |
| AD-579972.1 | 83.71 | 13.31 | 0.1 | nM |
| AD-579973.1 | 97.02 | 12.16 | 0.1 | nM |
| AD-579974.1 | 87.05 | 8.86 | 0.1 | nM |
| AD-579975.1 | 85.49 | 9.25 | 0.1 | nM |
| AD-579976.1 | 89.61 | 16.73 | 0.1 | nM |
| AD-579977.1 | 93.52 | 7.83 | 0.1 | nM |
| AD-579978.1 | 87.68 | 5.19 | 0.1 | nM |
| AD-579979.1 | 93.22 | 6.02 | 0.1 | nM |
| AD-579980.1 | 39.04 | 7.41 | 0.1 | nM |
| AD-579981.1 | 75.66 | 11.68 | 0.1 | nM |
| AD-579982.1 | 90.44 | 10.96 | 0.1 | nM |
| AD-579983.1 | 50.03 | 2.51 | 0.1 | nM |
| AD-579984.1 | 58.06 | 3.26 | 0.1 | nM |
| AD-579985.1 | 33.30 | 3.60 | 0.1 | nM |
| AD-579986.1 | 74.91 | 4.29 | 0.1 | nM |

TABLE 7A-continued

Cynomolgus monkey VEGF-A in vitro multi-dose screen with one set of exemplary rat VEGF-A siRNAs

| Duplex Name | Average | StDev | Dose | Dose Unit |
|---|---|---|---|---|
| AD-579987.1 | 71.15 | 8.39 | 0.1 | nM |
| AD-579988.1 | 81.86 | 6.80 | 0.1 | nM |
| AD-579989.1 | 59.63 | 7.75 | 0.1 | nM |
| AD-579990.1 | 95.13 | 9.94 | 0.1 | nM |
| AD-579992.1 | 94.26 | 5.07 | 0.1 | nM |
| AD-579993.1 | 99.78 | 15.90 | 0.1 | nM |
| AD-579995.1 | 73.91 | 9.98 | 0.1 | nM |
| AD-579996.1 | 101.07 | 13.27 | 0.1 | nM |
| AD-579997.1 | 89.33 | 7.03 | 0.1 | nM |
| AD-579998.1 | 60.03 | 5.93 | 0.1 | nM |
| AD-579999.1 | 109.04 | 17.76 | 0.1 | nM |
| AD-580000.1 | 108.28 | 13.14 | 0.1 | nM |
| AD-580001.1 | 88.49 | 11.96 | 0.1 | nM |
| AD-580002.1 | 122.07 | 18.09 | 0.1 | nM |

TABLE 7B

Mouse VEGF-A in vitro multi-dose screen with one set of exemplary rat VEGF-A siRNAs

| Duplex Name | Average | StDev | Dose | Dose Unit |
|---|---|---|---|---|
| AD-579911.1 | 21.27 | 3.91 | 10 | nM |
| AD-579912.1 | 16.53 | 5.79 | 10 | nM |
| AD-579913.1 | 16.73 | 4.22 | 10 | nM |
| AD-579914.1 | 16.51 | 1.15 | 10 | nM |
| AD-579915.1 | 18.33 | 6.95 | 10 | nM |
| AD-579916.1 | 25.18 | 1.82 | 10 | nM |
| AD-579917.1 | 12.22 | 1.48 | 10 | nM |
| AD-579918.1 | 11.07 | 2.65 | 10 | nM |
| AD-579919.1 | 12.63 | 1.67 | 10 | nM |
| AD-579921.1 | 11.45 | 2.37 | 10 | nM |
| AD-579922.1 | 14.90 | 3.21 | 10 | nM |
| AD-579923.1 | 13.67 | 3.59 | 10 | nM |
| AD-579924.1 | 26.37 | 2.49 | 10 | nM |
| AD-579925.1 | 10.16 | 1.07 | 10 | nM |
| AD-579926.1 | 14.22 | 0.82 | 10 | nM |
| AD-579927.1 | 32.32 | 5.45 | 10 | nM |
| AD-579929.1 | 22.15 | 6.29 | 10 | nM |
| AD-579930.1 | 74.90 | 13.83 | 10 | nM |
| AD-579931.1 | 53.69 | 19.88 | 10 | nM |
| AD-579932.1 | 24.54 | 2.62 | 10 | nM |
| AD-579933.1 | 20.31 | 4.52 | 10 | nM |
| AD-579934.1 | 36.61 | 3.37 | 10 | nM |
| AD-579935.1 | 24.55 | 4.10 | 10 | nM |
| AD-579936.1 | 22.50 | 4.65 | 10 | nM |
| AD-579937.1 | 32.75 | 3.55 | 10 | nM |
| AD-579938.1 | 13.39 | 2.36 | 10 | nM |
| AD-579939.1 | 4.62 | 0.19 | 10 | nM |
| AD-579940.1 | 3.68 | 1.38 | 10 | nM |
| AD-579941.1 | 8.87 | 1.96 | 10 | nM |
| AD-579942.1 | 3.71 | 1.54 | 10 | nM |
| AD-579943.1 | 11.89 | 1.92 | 10 | nM |
| AD-579944.1 | 12.26 | 1.40 | 10 | nM |
| AD-579945.1 | 16.73 | 1.86 | 10 | nM |
| AD-579946.1 | 18.67 | 5.27 | 10 | nM |
| AD-579947.1 | 6.39 | 1.71 | 10 | nM |
| AD-579948.1 | 27.00 | 3.21 | 10 | nM |
| AD-579949.1 | 35.57 | 2.31 | 10 | nM |
| AD-579950.1 | 53.80 | 4.29 | 10 | nM |
| AD-579951.1 | 17.89 | 3.43 | 10 | nM |
| AD-579953.1 | 24.48 | 3.96 | 10 | nM |
| AD-579954.1 | 21.78 | 1.63 | 10 | nM |
| AD-579955.1 | 30.54 | 3.58 | 10 | nM |
| AD-579956.1 | 27.17 | 1.58 | 10 | nM |
| AD-579957.1 | 16.61 | 1.30 | 10 | nM |
| AD-579958.1 | 53.03 | 4.43 | 10 | nM |
| AD-579959.1 | 40.73 | 3.55 | 10 | nM |
| AD-579960.1 | 41.68 | 1.59 | 10 | nM |
| AD-579961.1 | 29.58 | 7.59 | 10 | nM |

TABLE 7B-continued

Mouse VEGF-A in vitro multi-dose screen with one set of exemplary rat VEGF-A siRNAs

| Duplex Name | Average | StDev | Dose | Dose Unit |
|---|---|---|---|---|
| AD-579962.1 | 19.90 | 1.25 | 10 | nM |
| AD-579963.1 | 14.55 | 3.30 | 10 | nM |
| AD-579964.1 | 23.53 | 4.62 | 10 | nM |
| AD-579965.1 | 5.85 | 1.35 | 10 | nM |
| AD-579966.1 | 3.37 | 0.46 | 10 | nM |
| AD-579967.1 | 8.12 | 3.03 | 10 | nM |
| AD-579968.1 | 15.39 | 2.69 | 10 | nM |
| AD-579969.1 | 41.77 | 5.27 | 10 | nM |
| AD-579970.1 | 35.40 | 4.42 | 10 | nM |
| AD-579971.1 | 9.46 | 1.20 | 10 | nM |
| AD-579972.1 | 13.66 | 4.21 | 10 | nM |
| AD-579973.1 | 15.20 | 4.13 | 10 | nM |
| AD-579974.1 | 3.60 | 1.49 | 10 | nM |
| AD-579975.1 | 3.08 | 0.33 | 10 | nM |
| AD-579976.1 | 7.90 | 0.37 | 10 | nM |
| AD-579977.1 | 22.23 | 1.40 | 10 | nM |
| AD-579978.1 | 15.03 | 2.22 | 10 | nM |
| AD-579979.1 | 29.83 | 5.08 | 10 | nM |
| AD-579980.1 | 25.34 | 2.41 | 10 | nM |
| AD-579981.1 | 20.80 | 1.40 | 10 | nM |
| AD-579982.1 | 20.12 | 8.04 | 10 | nM |
| AD-579983.1 | 22.13 | 4.26 | 10 | nM |
| AD-579984.1 | 11.34 | 1.30 | 10 | nM |
| AD-579985.1 | 10.84 | 0.91 | 10 | nM |
| AD-579986.1 | 22.36 | 1.53 | 10 | nM |
| AD-579987.1 | 26.77 | 5.29 | 10 | nM |
| AD-579988.1 | 25.91 | 6.97 | 10 | nM |
| AD-579989.1 | 17.89 | 1.51 | 10 | nM |
| AD-579990.1 | 29.33 | 3.43 | 10 | nM |
| AD-579992.1 | 19.38 | 7.67 | 10 | nM |
| AD-579993.1 | 23.19 | 0.70 | 10 | nM |
| AD-579995.1 | 4.97 | 1.31 | 10 | nM |
| AD-579996.1 | 63.08 | 6.91 | 10 | nM |
| AD-579997.1 | 26.46 | 4.46 | 10 | nM |
| AD-579998.1 | 17.58 | 4.81 | 10 | nM |
| AD-579999.1 | 33.79 | 5.04 | 10 | nM |
| AD-580000.1 | 28.19 | 4.07 | 10 | nM |
| AD-580001.1 | 23.17 | 4.55 | 10 | nM |
| AD-580002.1 | 51.58 | 4.73 | 10 | nM |
| AD-579911.1 | 29.66 | 4.64 | 1 | nM |
| AD-579912.1 | 26.43 | 3.94 | 1 | nM |
| AD-579913.1 | 40.12 | 5.03 | 1 | nM |
| AD-579914.1 | 24.93 | 2.78 | 1 | nM |
| AD-579915.1 | 34.06 | 4.64 | 1 | nM |
| AD-579916.1 | 45.46 | 4.47 | 1 | nM |
| AD-579917.1 | 19.16 | 2.98 | 1 | nM |
| AD-579918.1 | 16.77 | 1.65 | 1 | nM |
| AD-579919.1 | 17.09 | 1.57 | 1 | nM |
| AD-579921.1 | 21.90 | 0.76 | 1 | nM |
| AD-579922.1 | 24.16 | 3.67 | 1 | nM |
| AD-579923.1 | 28.64 | 5.98 | 1 | nM |
| AD-579924.1 | 54.14 | 8.12 | 1 | nM |
| AD-579925.1 | 27.88 | 2.54 | 1 | nM |
| AD-579926.1 | 29.26 | 2.01 | 1 | nM |
| AD-579927.1 | 44.60 | 5.25 | 1 | nM |
| AD-579929.1 | 31.53 | 4.15 | 1 | nM |
| AD-579930.1 | 93.72 | 13.68 | 1 | nM |
| AD-579931.1 | 54.78 | 5.31 | 1 | nM |
| AD-579932.1 | 46.12 | 4.65 | 1 | nM |
| AD-579933.1 | 27.01 | 5.56 | 1 | nM |
| AD-579934.1 | 40.35 | 6.96 | 1 | nM |
| AD-579935.1 | 31.13 | 5.41 | 1 | nM |
| AD-579936.1 | 29.73 | 3.71 | 1 | nM |
| AD-579937.1 | 44.09 | 4.36 | 1 | nM |
| AD-579938.1 | 21.66 | 3.66 | 1 | nM |
| AD-579939.1 | 4.58 | 0.75 | 1 | nM |
| AD-579940.1 | 3.56 | 0.91 | 1 | nM |
| AD-579941.1 | 7.55 | 2.31 | 1 | nM |
| AD-579942.1 | 5.56 | 2.57 | 1 | nM |
| AD-579943.1 | 19.30 | 3.06 | 1 | nM |
| AD-579944.1 | 18.70 | 1.80 | 1 | nM |
| AD-579945.1 | 26.86 | 1.35 | 1 | nM |
| AD-579946.1 | 21.86 | 3.32 | 1 | nM |
| AD-579947.1 | 9.84 | 0.95 | 1 | nM |

TABLE 7B-continued

Mouse VEGF-A in vitro multi-dose screen with one set of exemplary rat VEGF-A siRNAs

| Duplex Name | Average | StDev | Dose | Dose Unit |
|---|---|---|---|---|
| AD-579948.1 | 26.84 | 1.26 | 1 | nM |
| AD-579949.1 | 57.75 | 9.08 | 1 | nM |
| AD-579950.1 | 54.60 | 4.99 | 1 | nM |
| AD-579951.1 | 23.18 | 1.60 | 1 | nM |
| AD-579953.1 | 35.85 | 4.89 | 1 | nM |
| AD-579954.1 | 33.37 | 3.57 | 1 | nM |
| AD-579955.1 | 43.72 | 4.02 | 1 | nM |
| AD-579956.1 | 40.52 | 0.43 | 1 | nM |
| AD-579957.1 | 22.05 | 1.37 | 1 | nM |
| AD-579958.1 | 63.71 | 6.37 | 1 | nM |
| AD-579959.1 | 54.17 | 7.09 | 1 | nM |
| AD-579960.1 | 45.58 | 4.07 | 1 | nM |
| AD-579961.1 | 40.91 | 2.43 | 1 | nM |
| AD-579962.1 | 28.65 | 3.39 | 1 | nM |
| AD-579963.1 | 22.65 | 6.61 | 1 | nM |
| AD-579964.1 | 28.01 | 5.38 | 1 | nM |
| AD-579965.1 | 3.88 | 1.04 | 1 | nM |
| AD-579966.1 | 4.08 | 1.00 | 1 | nM |
| AD-579967.1 | 14.72 | 0.97 | 1 | nM |
| AD-579968.1 | 19.71 | 4.24 | 1 | nM |
| AD-579969.1 | 54.35 | 7.63 | 1 | nM |
| AD-579970.1 | 52.04 | 1.90 | 1 | nM |
| AD-579971.1 | 13.28 | 3.80 | 1 | nM |
| AD-579972.1 | 22.49 | 5.22 | 1 | nM |
| AD-579973.1 | 23.49 | 2.63 | 1 | nM |
| AD-579974.1 | 6.50 | 0.84 | 1 | nM |
| AD-579975.1 | 3.65 | 1.14 | 1 | nM |
| AD-579976.1 | 10.00 | 2.25 | 1 | nM |
| AD-579977.1 | 30.06 | 5.34 | 1 | nM |
| AD-579978.1 | 21.05 | 2.77 | 1 | nM |
| AD-579979.1 | 54.05 | 6.94 | 1 | nM |
| AD-579980.1 | 26.38 | 3.38 | 1 | nM |
| AD-579981.1 | 22.68 | 2.02 | 1 | nM |
| AD-579982.1 | 39.84 | 3.32 | 1 | nM |
| AD-579983.1 | 34.64 | 6.02 | 1 | nM |
| AD-579984.1 | 16.95 | 2.53 | 1 | nM |
| AD-579985.1 | 31.39 | 1.48 | 1 | nM |
| AD-579986.1 | 27.74 | 3.81 | 1 | nM |
| AD-579987.1 | 51.76 | 4.91 | 1 | nM |
| AD-579988.1 | 29.45 | 2.77 | 1 | nM |
| AD-579989.1 | 21.33 | 2.08 | 1 | nM |
| AD-579990.1 | 47.89 | 1.76 | 1 | nM |
| AD-579992.1 | 30.71 | 4.73 | 1 | nM |
| AD-579993.1 | 35.91 | 7.25 | 1 | nM |
| AD-579995.1 | 6.70 | 0.49 | 1 | nM |
| AD-579996.1 | 74.23 | 4.02 | 1 | nM |
| AD-579997.1 | 51.99 | 10.00 | 1 | nM |
| AD-579998.1 | 20.92 | 4.64 | 1 | nM |
| AD-579999.1 | 40.31 | 1.99 | 1 | nM |
| AD-580000.1 | 38.17 | 1.63 | 1 | nM |
| AD-580001.1 | 28.86 | 5.37 | 1 | nM |
| AD-580002.1 | 51.52 | 7.91 | 1 | nM |
| AD-579911.1 | 59.37 | 8.87 | 0.1 | nM |
| AD-579912.1 | 59.39 | 5.09 | 0.1 | nM |
| AD-579913.1 | 64.08 | 23.73 | 0.1 | nM |
| AD-579914.1 | 49.48 | 3.64 | 0.1 | nM |
| AD-579915.1 | 56.56 | 6.31 | 0.1 | nM |
| AD-579916.1 | 96.79 | 16.03 | 0.1 | nM |
| AD-579917.1 | 45.36 | 7.75 | 0.1 | nM |
| AD-579918.1 | 57.38 | 4.03 | 0.1 | nM |
| AD-579919.1 | 55.62 | 5.60 | 0.1 | nM |
| AD-579921.1 | 53.70 | 9.76 | 0.1 | nM |
| AD-579922.1 | 62.44 | 4.87 | 0.1 | nM |
| AD-579923.1 | 63.54 | 9.06 | 0.1 | nM |
| AD-579924.1 | 92.45 | 9.57 | 0.1 | nM |
| AD-579925.1 | 61.94 | 18.45 | 0.1 | nM |
| AD-579926.1 | 70.86 | 8.69 | 0.1 | nM |
| AD-579927.1 | 78.15 | 23.69 | 0.1 | nM |
| AD-579929.1 | 71.46 | 14.26 | 0.1 | nM |
| AD-579930.1 | 90.78 | 6.27 | 0.1 | nM |
| AD-579931.1 | 68.75 | 9.57 | 0.1 | nM |
| AD-579932.1 | 77.69 | 9.74 | 0.1 | nM |
| AD-579933.1 | 51.36 | 9.29 | 0.1 | nM |
| AD-579934.1 | 77.13 | 7.91 | 0.1 | nM |
| AD-579935.1 | 49.67 | 7.46 | 0.1 | nM |
| AD-579936.1 | 44.13 | 6.15 | 0.1 | nM |
| AD-579937.1 | 77.96 | 4.22 | 0.1 | nM |
| AD-579938.1 | 29.19 | 7.09 | 0.1 | nM |
| AD-579939.1 | 10.14 | 1.04 | 0.1 | nM |
| AD-579940.1 | 6.98 | 3.06 | 0.1 | nM |
| AD-579941.1 | 7.68 | 1.31 | 0.1 | nM |
| AD-579942.1 | 8.97 | 1.33 | 0.1 | nM |
| AD-579943.1 | 37.14 | 5.93 | 0.1 | nM |
| AD-579944.1 | 39.47 | 3.54 | 0.1 | nM |
| AD-579945.1 | 54.76 | 10.45 | 0.1 | nM |
| AD-579946.1 | 54.38 | 7.47 | 0.1 | nM |
| AD-579947.1 | 22.79 | 5.03 | 0.1 | nM |
| AD-579948.1 | 38.00 | 6.15 | 0.1 | nM |
| AD-579949.1 | 80.25 | 7.57 | 0.1 | nM |
| AD-579950.1 | 73.79 | 5.42 | 0.1 | nM |
| AD-579951.1 | 47.34 | 5.57 | 0.1 | nM |
| AD-579953.1 | 75.21 | 13.06 | 0.1 | nM |
| AD-579954.1 | 49.75 | 4.87 | 0.1 | nM |
| AD-579955.1 | 84.04 | 10.95 | 0.1 | nM |
| AD-579956.1 | 73.48 | 18.05 | 0.1 | nM |
| AD-579957.1 | 37.29 | 3.15 | 0.1 | nM |
| AD-579958.1 | 96.73 | 8.67 | 0.1 | nM |
| AD-579959.1 | 86.90 | 10.17 | 0.1 | nM |
| AD-579960.1 | 71.64 | 12.07 | 0.1 | nM |
| AD-579961.1 | 86.22 | 11.71 | 0.1 | nM |
| AD-579962.1 | 59.52 | 4.17 | 0.1 | nM |
| AD-579963.1 | 53.65 | 1.36 | 0.1 | nM |
| AD-579964.1 | 60.89 | 5.53 | 0.1 | nM |
| AD-579965.1 | 10.37 | 1.33 | 0.1 | nM |
| AD-579966.1 | 9.37 | 1.18 | 0.1 | nM |
| AD-579967.1 | 33.20 | 1.60 | 0.1 | nM |
| AD-579968.1 | 36.38 | 8.49 | 0.1 | nM |
| AD-579969.1 | 83.90 | 5.81 | 0.1 | nM |
| AD-579970.1 | 104.17 | 11.38 | 0.1 | nM |
| AD-579971.1 | 29.04 | 4.62 | 0.1 | nM |
| AD-579972.1 | 47.77 | 5.87 | 0.1 | nM |
| AD-579973.1 | 67.38 | 5.17 | 0.1 | nM |
| AD-579974.1 | 21.80 | 3.23 | 0.1 | nM |
| AD-579975.1 | 10.78 | 2.10 | 0.1 | nM |
| AD-579976.1 | 20.60 | 3.17 | 0.1 | nM |
| AD-579977.1 | 86.60 | 5.20 | 0.1 | nM |
| AD-579978.1 | 53.36 | 3.32 | 0.1 | nM |
| AD-579979.1 | 92.09 | 11.37 | 0.1 | nM |
| AD-579980.1 | 52.60 | 2.36 | 0.1 | nM |
| AD-579981.1 | 46.23 | 7.60 | 0.1 | nM |
| AD-579982.1 | 94.15 | 11.36 | 0.1 | nM |
| AD-579983.1 | 76.94 | 11.93 | 0.1 | nM |
| AD-579984.1 | 34.98 | 2.84 | 0.1 | nM |
| AD-579985.1 | 69.50 | 9.11 | 0.1 | nM |
| AD-579986.1 | 62.04 | 6.78 | 0.1 | nM |
| AD-579987.1 | 89.22 | 9.48 | 0.1 | nM |
| AD-579988.1 | 72.80 | 14.40 | 0.1 | nM |
| AD-579989.1 | 52.85 | 3.85 | 0.1 | nM |
| AD-579990.1 | 94.01 | 8.85 | 0.1 | nM |
| AD-579992.1 | 67.82 | 6.38 | 0.1 | nM |
| AD-579993.1 | 81.30 | 15.42 | 0.1 | nM |
| AD-579995.1 | 19.72 | 5.72 | 0.1 | nM |
| AD-579996.1 | 97.03 | 10.38 | 0.1 | nM |
| AD-579997.1 | 87.06 | 12.93 | 0.1 | nM |
| AD-579998.1 | 52.54 | 4.98 | 0.1 | nM |
| AD-579999.1 | 71.80 | 3.62 | 0.1 | nM |
| AD-580000.1 | 75.04 | 9.15 | 0.1 | nM |
| AD-580001.1 | 59.52 | 8.32 | 0.1 | nM |
| AD-580002.1 | 90.07 | 10.26 | 0.1 | nM |

The results of the multi-dose screen in primary human hepatocytes transfected with one set of exemplary human VEGF-A siRNAs is shown in Table 9A (correspond to siRNAs in Table 8A and 8B) The multi-dose experiments were performed at 50 nM, 10 nM, 1 nM, and 0.1 nM final duplex concentrations and the data are expressed as percent message remaining relative to non-targeting control.

Of the exemplary siRNA duplexes evaluated in Table 9A, 1 achieved a knockdown of VEGF-A of ≥80%, 119 achieved a knockdown of VEGF-A of ≥60%, and 363 achieved a knockdown of VEGF-A of ≥30% when administered at the 50 nM concentration.

Of the exemplary siRNA duplexes evaluated in Table 9A, 2 achieved a knockdown of VEGF-A of ≥80%, 103 achieved a knockdown of VEGF-A of ≥60%, and 364 achieved a knockdown of VEGF-A of ≥30% when administered at the 10 nM concentration.

Of the exemplary siRNA duplexes evaluated in Table 9A, 13 achieved a knockdown of VEGF-A of ≥70%, 52 achieved a knockdown of VEGF-A of ≥60%, and 312 achieved a knockdown of VEGF-A of ≥30% when administered at the 1 nM concentration.

Of the exemplary siRNA duplexes evaluated in Table 9A, 8 achieved a knockdown of VEGF-A of ≥50%, 75 achieved a knockdown of VEGF-A of ≥40%, and 170 achieved a knockdown of VEGF-A of ≥30% when administered at the 0.1 nM concentration.

TABLE 9A

VEGF-A endogenous in vitro multi-dose screen following cellular transfection with one set of exemplary human VEGF-A siRNAs

| DuplexID | 50 nM | StDev | 10 nM | StDev | 1 nM | StDev | 0.1 nM | StDev |
|---|---|---|---|---|---|---|---|---|
| AD-1222866.1 | 70 | 22 | 58 | 9 | 69 | 9 | 60 | 6 |
| AD-1222867.1 | 64 | 14 | 38 | 6 | 55 | 3 | 54 | 2 |
| AD-1222868.1 | 60 | 7 | 42 | 6 | 56 | 8 | 55 | 3 |
| AD-1222869.1 | 61 | 3 | 51 | 1 | 56 | 3 | 56 | 0 |
| AD-1222870.1 | 43 | 7 | 39 | 6 | 47 | 7 | 52 | 4 |
| AD-1222871.1 | 41 | 3 | 38 | 7 | 42 | 2 | 56 | 3 |
| AD-1222872.1 | 54 | 4 | 46 | 9 | 50 | 1 | 56 | 2 |
| AD-1222873.1 | 44 | 1 | 44 | 4 | 46 | 2 | 58 | 1 |
| AD-1222874.1 | 78 | 22 | 66 | 18 | 69 | 4 | 70 | 2 |
| AD-1222875.1 | 56 | 7 | 51 | 5 | 64 | 3 | 59 | 4 |
| AD-1222876.1 | 56 | 9 | 64 | 6 | 71 | 8 | 67 | 4 |
| AD-1222877.1 | 60 | 19 | 50 | 5 | 59 | 7 | 67 | 3 |
| AD-1222878.1 | 64 | 7 | 60 | 2 | 63 | 3 | 72 | 4 |
| AD-1222879.1 | 64 | 3 | 57 | 9 | 52 | 4 | 64 | 9 |
| AD-1222880.1 | 54 | 4 | 53 | 9 | 49 | 4 | 57 | 4 |
| AD-1222881.1 | 58 | 10 | 51 | 2 | 46 | 1 | 63 | 9 |
| AD-1222882.1 | 93 | 12 | 74 | 14 | 93 | 12 | 91 | 12 |
| AD-1222883.1 | 72 | 12 | 59 | 10 | 64 | 7 | 78 | 9 |
| AD-1222884.1 | 63 | 5 | 58 | 8 | 61 | 0 | 79 | 10 |
| AD-1222885.1 | 70 | 12 | 66 | 9 | 69 | 11 | 81 | 4 |
| AD-1222886.1 | 77 | 7 | 76 | 7 | 69 | 3 | 80 | 6 |
| AD-1222887.1 | 62 | 5 | 58 | 11 | 57 | 4 | 70 | 9 |
| AD-1222888.1 | 69 | 6 | 68 | 8 | 64 | 7 | 65 | 4 |
| AD-1222889.1 | 95 | 16 | 81 | 13 | 98 | 11 | 128 | 54 |
| AD-1222890.1 | 88 | 4 | 85 | 11 | 81 | 10 | 97 | 15 |
| AD-1222891.1 | 91 | 15 | 70 | 7 | 77 | 7 | 84 | 16 |
| AD-1222892.1 | 77 | 3 | 75 | 16 | 82 | 22 | 84 | 5 |
| AD-1222893.1 | 84 | 4 | 77 | 14 | 74 | 4 | 85 | 3 |
| AD-1222894.1 | 66 | 6 | 53 | 0 | 61 | 8 | 77 | 10 |
| AD-1222895.1 | 66 | 8 | 68 | 11 | 69 | 6 | 71 | 8 |
| AD-1222896.1 | 99 | 18 | 82 | 25 | 88 | 13 | 124 | 18 |
| AD-1222897.1 | 94 | 10 | 95 | 6 | 76 | 7 | 88 | 14 |
| AD-1222898.1 | 107 | 13 | 93 | 3 | 85 | 10 | 91 | 15 |
| AD-1222899.1 | 98 | 15 | 108 | 5 | 78 | 3 | 90 | 9 |
| AD-1222900.1 | 83 | 14 | 83 | 2 | 82 | 1 | 91 | 8 |
| AD-1222901.1 | 85 | 11 | 81 | 10 | 90 | 15 | 82 | 11 |
| AD-1222902.1 | 71 | 11 | 70 | 6 | 78 | 7 | 87 | 11 |
| AD-1222903.1 | 85 | 5 | 66 | 10 | 80 | 11 | 81 | 6 |
| AD-1222904.1 | 99 | 13 | 87 | 18 | 87 | 9 | 109 | 20 |
| AD-1222905.1 | 109 | 10 | 97 | 14 | 91 | 10 | 103 | 20 |
| AD-1222906.1 | 117 | 6 | 94 | 14 | 85 | 8 | 78 | 3 |
| AD-1222907.1 | 91 | 15 | 85 | 11 | 73 | 20 | 81 | 13 |
| AD-1222908.1 | 82 | 5 | 77 | 11 | 81 | 19 | 90 | 11 |
| AD-1222909.1 | 83 | 8 | 85 | 16 | 62 | 13 | 89 | 8 |
| AD-1222910.1 | 71 | 7 | 78 | 9 | 70 | 2 | 86 | 9 |
| AD-1222911.1 | 129 | 1 | 93 | 17 | 102 | 3 | 116 | 24 |
| AD-1222912.1 | 117 | 11 | 115 | 10 | 98 | 10 | 114 | 7 |
| AD-1222913.1 | 103 | 9 | 89 | 6 | 91 | 5 | 110 | 19 |
| AD-1222914.1 | 72 | 3 | 63 | 3 | 80 | 16 | 91 | 11 |
| AD-1222915.1 | 59 | 11 | 60 | 6 | 80 | 7 | 100 | 8 |
| AD-1222916.1 | 49 | 6 | 42 | 5 | 43 | 12 | 94 | 10 |
| AD-1222917.1 | 61 | 2 | 49 | 6 | 62 | 7 | 85 | 4 |
| AD-1222918.1 | 70 | 12 | 69 | 4 | 77 | 4 | 94 | 4 |
| AD-1222920.1 | 87 | 15 | 71 | 6 | 59 | 5 | 90 | 10 |
| AD-1222921.1 | 104 | 8 | 105 | 6 | 89 | 10 | 103 | 13 |
| AD-1222922.1 | 68 | 7 | 78 | 3 | 88 | 18 | 78 | 14 |
| AD-1222923.1 | 58 | 4 | 64 | 8 | 64 | 5 | 90 | 2 |
| AD-1222924.1 | 82 | 10 | 84 | 13 | 83 | 17 | 100 | 2 |
| AD-1222925.1 | 71 | 7 | 83 | 11 | 84 | 13 | 91 | 0 |
| AD-1222926.1 | 90 | 9 | 87 | 9 | 80 | 2 | 101 | 2 |
| AD-1222927.1 | 95 | 14 | 84 | 3 | 76 | 4 | 103 | 21 |
| AD-1222928.1 | 62 | 4 | 54 | 5 | 54 | 4 | 84 | 3 |

TABLE 9A-continued

VEGF-A endogenous in vitro multi-dose screen following cellular transfection with one set of exemplary human VEGF-A siRNAs

| DuplexID | 50 nM | StDev | 10 nM | StDev | 1 nM | StDev | 0.1 nM | StDev |
|---|---|---|---|---|---|---|---|---|
| AD-1222929.1 | 79 | 9 | 61 | 6 | 69 | 2 | 87 | 23 |
| AD-1222930.1 | 59 | 1 | 62 | 1 | 68 | 2 | 95 | 8 |
| AD-1222931.1 | 55 | 4 | 58 | 2 | 64 | 3 | 89 | 16 |
| AD-1222932.1 | 75 | 18 | 87 | 8 | 93 | 11 | 88 | 7 |
| AD-1222933.1 | 40 | 12 | 47 | 5 | 45 | 3 | 87 | 17 |
| AD-1222934.1 | 56 | 8 | 42 | 5 | 48 | 10 | 68 | 8 |
| AD-1222935.1 | 41 | 0 | 41 | 2 | 46 | 4 | 66 | 8 |
| AD-1222936.1 | 39 | 3 | 50 | 2 | 54 | 1 | 73 | 8 |
| AD-1222937.1 | 50 | 13 | 52 | 10 | 63 | 7 | 89 | 9 |
| AD-1222938.1 | 46 | 5 | 67 | 8 | 72 | 4 | 96 | 7 |
| AD-1222939.1 | 37 | 2 | 41 | 7 | 57 | 13 | 82 | 4 |
| AD-1222940.1 | 36 | 6 | 45 | 8 | 47 | 8 | 74 | 17 |
| AD-1222941.1 | 89 | 12 | 76 | 9 | 85 | 6 | 85 | 17 |
| AD-1222942.1 | 44 | 7 | 39 | 3 | 43 | 6 | 67 | 4 |
| AD-1222943.1 | 81 | 17 | 77 | 6 | 85 | 5 | 100 | 5 |
| AD-1222944.1 | 53 | 11 | 50 | 4 | 59 | 14 | 85 | 9 |
| AD-1222945.1 | 74 | 12 | 73 | 0 | 84 | 23 | 92 | 4 |
| AD-1222946.1 | 37 | 3 | 44 | 4 | 76 | 7 | 89 | 7 |
| AD-1222947.1 | 31 | 4 | 31 | 3 | 52 | 3 | 54 | 4 |
| AD-1222948.1 | 58 | 12 | 60 | 6 | 88 | 14 | 111 | 52 |
| AD-1222949.1 | 52 | 12 | 52 | 11 | 63 | 17 | 109 | 13 |
| AD-1222950.1 | 52 | 18 | 51 | 1 | 72 | 7 | 113 | 21 |
| AD-1222951.1 | 37 | 12 | 34 | 5 | 42 | 1 | 95 | 19 |
| AD-1222952.1 | 78 | 4 | 89 | 6 | 103 | 1 | 137 | 44 |
| AD-1222953.1 | 27 | 6 | 30 | 2 | 57 | 6 | 119 | 47 |
| AD-1222954.1 | 33 | 4 | 40 | 4 | 68 | 12 | 102 | 35 |
| AD-1222955.1 | 38 | 9 | 39 | 3 | 53 | 5 | 116 | 54 |
| AD-1222956.1 | 34 | 6 | 42 | 7 | 58 | 20 | 69 | 5 |
| AD-1222957.1 | 23 | 3 | 30 | 2 | 55 | 20 | 62 | 9 |
| AD-1222958.1 | 21 | 3 | 35 | 15 | 35 | 8 | 59 | 4 |
| AD-1222959.1 | 21 | 2 | 30 | 8 | 39 | 7 | 65 | 1 |
| AD-1222960.1 | 25 | 2 | 32 | 6 | 39 | 1 | 68 | 11 |
| AD-1222961.1 | 32 | 5 | 25 | 1 | 41 | 7 | 54 | 2 |
| AD-1222962.1 | 33 | 3 | 34 | 6 | 34 | 8 | 55 | 5 |
| AD-1222963.1 | 26 | 3 | 24 | 0 | 34 | 13 | 61 | 3 |
| AD-1222964.1 | 37 | 1 | 47 | 7 | 78 | 10 | 87 | 14 |
| AD-1222965.1 | 49 | 0 | 58 | 19 | 81 | 11 | 88 | 3 |
| AD-1222966.1 | 48 | 7 | 51 | 4 | 59 | 6 | 82 | 3 |
| AD-1222967.1 | 36 | 2 | 34 | 2 | 49 | 6 | 67 | 8 |
| AD-1222968.1 | 39 | 3 | 47 | 5 | 53 | 10 | 73 | 7 |
| AD-1222969.1 | 30 | 1 | 28 | 3 | 41 | 11 | 55 | 5 |
| AD-1222970.1 | 18 | 1 | 19 | 2 | 25 | 10 | 41 | 2 |
| AD-1222971.1 | 40 | 5 | 35 | 2 | 44 | 4 | 58 | 4 |
| AD-1222972.1 | 41 | 4 | 47 | 8 | 87 | 7 | 87 | 11 |
| AD-1222973.1 | 28 | 2 | 31 | 10 | 52 | 7 | 71 | 8 |
| AD-1222974.1 | 38 | 4 | 29 | 2 | 57 | 8 | 67 | 11 |
| AD-1222975.1 | 35 | 3 | 28 | 2 | 48 | 15 | 72 | 6 |
| AD-1222976.1 | 24 | 1 | 23 | 5 | 33 | 2 | 49 | 2 |
| AD-1222977.1 | 22 | 1 | 20 | 2 | 28 | 5 | 47 | 4 |
| AD-1222978.1 | 27 | 6 | 24 | 6 | 31 | 7 | 50 | 3 |
| AD-1222979.1 | 52 | 11 | 52 | 0 | 71 | 13 | 103 | 26 |
| AD-1222980.1 | 46 | 5 | 41 | 5 | 65 | 9 | 91 | 2 |
| AD-1222981.1 | 49 | 4 | 41 | 3 | 59 | 11 | 76 | 2 |
| AD-1222982.1 | 35 | 5 | 29 | 1 | 44 | 7 | 64 | 4 |
| AD-1222983.1 | 32 | 4 | 28 | 2 | 35 | 10 | 54 | 1 |
| AD-1222984.1 | 29 | 2 | 25 | 1 | 32 | 1 | 53 | 3 |
| AD-1222985.1 | 37 | 3 | 34 | 7 | 43 | 6 | 57 | 3 |
| AD-1222986.1 | 34 | 2 | 34 | 1 | 65 | 13 | 94 | 23 |
| AD-1222987.1 | 38 | 5 | 35 | 7 | 48 | 10 | 73 | 9 |
| AD-1222988.1 | 31 | 0 | 27 | 1 | 38 | 2 | 59 | 7 |
| AD-1222989.1 | 35 | 2 | 29 | 5 | 42 | 2 | 59 | 4 |
| AD-1222990.1 | 30 | 4 | 34 | 10 | 37 | 7 | 59 | 6 |
| AD-1222991.1 | 26 | 1 | 21 | 2 | 37 | 9 | 59 | 9 |
| AD-1222992.1 | 39 | 5 | 38 | 0 | 49 | 14 | 65 | 1 |
| AD-1222993.1 | 39 | 1 | 36 | 3 | 43 | 5 | 80 | 17 |
| AD-1222994.1 | 46 | 3 | 48 | 6 | 54 | 1 | 82 | 3 |
| AD-1222995.1 | 47 | 5 | 36 | 5 | 67 | 16 | 76 | 7 |
| AD-1222996.1 | 58 | 7 | 50 | 4 | 60 | 4 | 79 | 2 |
| AD-1222997.1 | 40 | 8 | 37 | 5 | 50 | 4 | 53 | 9 |
| AD-1222998.1 | 43 | 8 | 39 | 4 | 51 | 3 | 51 | 7 |
| AD-1222999.1 | 40 | 1 | 43 | 12 | 45 | 2 | 60 | 5 |
| AD-1223000.1 | 55 | 12 | 45 | 4 | 53 | 2 | 69 | 4 |
| AD-1223001.1 | 56 | 7 | 62 | 9 | 77 | 15 | 103 | 15 |
| AD-1223002.1 | 69 | 1 | 65 | 1 | 78 | 6 | 86 | 9 |
| AD-1223003.1 | 52 | 10 | 46 | 10 | 60 | 9 | 72 | 5 |

TABLE 9A-continued

VEGF-A endogenous in vitro multi-dose screen following cellular transfection with one set of exemplary human VEGF-A siRNAs

| DuplexID | 50 nM | StDev | 10 nM | StDev | 1 nM | StDev | 0.1 nM | StDev |
|---|---|---|---|---|---|---|---|---|
| AD-1223004.1 | 34 | 2 | 32 | 3 | 41 | 9 | 58 | 4 |
| AD-1223005.1 | 47 | 1 | 51 | 12 | 51 | 12 | 67 | 7 |
| AD-1223006.1 | 35 | 2 | 32 | 2 | 39 | 1 | 61 | 7 |
| AD-1223007.1 | 55 | 7 | 42 | 3 | 54 | 10 | 61 | 6 |
| AD-1223008.1 | 32 | 4 | 29 | 1 | 37 | 1 | 68 | 10 |
| AD-1223009.1 | 40 | 3 | 47 | 7 | 54 | 6 | 97 | 15 |
| AD-1223010.1 | 52 | 2 | 46 | 3 | 58 | 8 | 85 | 6 |
| AD-1223011.1 | 44 | 2 | 39 | 5 | 39 | 7 | 58 | 7 |
| AD-1223012.1 | 32 | 3 | 37 | 4 | 39 | 5 | 61 | 7 |
| AD-1223013.1 | 78 | 9 | 65 | 10 | 60 | 4 | 79 | 4 |
| AD-1223014.1 | 64 | 10 | 50 | 4 | 46 | 7 | 76 | 4 |
| AD-1223015.1 | 38 | 5 | 29 | 3 | 43 | 8 | 64 | 4 |
| AD-1223016.1 | 47 | 11 | 31 | 3 | 35 | 6 | 81 | 17 |
| AD-1223017.1 | 55 | 4 | 52 | 2 | 53 | 8 | 89 | 23 |
| AD-1223018.1 | 39 | 0 | 45 | 12 | 47 | 1 | 75 | 16 |
| AD-1223019.1 | 39 | 5 | 36 | 4 | 46 | 14 | 67 | 2 |
| AD-1223020.1 | 48 | 9 | 47 | 15 | 44 | 9 | 68 | 2 |
| AD-1223021.1 | 50 | 7 | 42 | 5 | 41 | 1 | 68 | 13 |
| AD-1223022.1 | 34 | 4 | 31 | 2 | 37 | 5 | 61 | 13 |
| AD-1223023.1 | 66 | 7 | 56 | 2 | 59 | 9 | 80 | 13 |
| AD-1223024.1 | 55 | 10 | 52 | 6 | 78 | 9 | 115 | 31 |
| AD-1223025.1 | 49 | 4 | 47 | 4 | 60 | 1 | 109 | 9 |
| AD-1223026.1 | 55 | 6 | 55 | 6 | 59 | 14 | 86 | 10 |
| AD-1223027.1 | 66 | 3 | 63 | 10 | 70 | 19 | 90 | 1 |
| AD-1223028.1 | 54 | 6 | 48 | 6 | 53 | 3 | 82 | 15 |
| AD-1223029.1 | 52 | 3 | 50 | 8 | 62 | 1 | 81 | 7 |
| AD-1223030.1 | 53 | 7 | 49 | 7 | 48 | 2 | 74 | 12 |
| AD-1223031.1 | 44 | 8 | 38 | 3 | 60 | 5 | 88 | 14 |
| AD-1223032.1 | 51 | 2 | 53 | 2 | 57 | 4 | 88 | 8 |
| AD-1223033.1 | 46 | 2 | 49 | 15 | 63 | 10 | 77 | 18 |
| AD-1223034.1 | 53 | 18 | 36 | 4 | 57 | 19 | 81 | 11 |
| AD-1223035.1 | 50 | 2 | 49 | 15 | 50 | 9 | 65 | 4 |
| AD-1223036.1 | 40 | 3 | 34 | 6 | 43 | 5 | 77 | 31 |
| AD-1223037.1 | 42 | 3 | 33 | 5 | 37 | 6 | 55 | 8 |
| AD-1223038.1 | 30 | 4 | 32 | 1 | 29 | 1 | 62 | 2 |
| AD-1223039.1 | 67 | 3 | 48 | 8 | 68 | 12 | 74 | 14 |
| AD-1223040.1 | 61 | 1 | 54 | 13 | 56 | 9 | 73 | 10 |
| AD-1223041.1 | 57 | 7 | 44 | 4 | 65 | 17 | 91 | 7 |
| AD-1223042.1 | 62 | 32 | 46 | 6 | 55 | 13 | 71 | 4 |
| AD-1223043.1 | 41 | 5 | 40 | 3 | 46 | 8 | 79 | 6 |
| AD-1223044.1 | 53 | 17 | 39 | 2 | 43 | 6 | 73 | 9 |
| AD-1223045.1 | 54 | 0 | 40 | 2 | 44 | 3 | 67 | 9 |
| AD-1223046.1 | 49 | 13 | 43 | 3 | 32 | 3 | 103 | 1 |
| AD-1223047.1 | 55 | 4 | 41 | 4 | 26 | 7 | 97 | 8 |
| AD-1223048.1 | 43 | 2 | 39 | 3 | 25 | 8 | 99 | 14 |
| AD-1223049.1 | 31 | 2 | 35 | 1 | 36 | 10 | 107 | 9 |
| AD-1223050.1 | 32 | 4 | 37 | 3 | 63 | 5 | 106 | 21 |
| AD-1223051.1 | 55 | 4 | 48 | 3 | 74 | 30 | 114 | 16 |
| AD-1223052.1 | 50 | 12 | 39 | 3 | 62 | 4 | 107 | 14 |
| AD-1223053.1 | 37 | 2 | 44 | 6 | 41 | 13 | 90 | 12 |
| AD-1223054.1 | 51 | 23 | 48 | 1 | 28 | 5 | 98 | 11 |
| AD-1223055.1 | 63 | 41 | 44 | 1 | 22 | 2 | 79 | 8 |
| AD-1223056.1 | 49 | 1 | 45 | 1 | 25 | 5 | 83 | 11 |
| AD-1223057.1 | 41 | 13 | 42 | 6 | 39 | 15 | 79 | 11 |
| AD-1223058.1 | 26 | 3 | 33 | 2 | 53 | 25 | 77 | 10 |
| AD-1223059.1 | 32 | 2 | 37 | 0 | 50 | 11 | 71 | 10 |
| AD-1223060.1 | 41 | 13 | 38 | 3 | 50 | 2 | 78 | 2 |
| AD-1223061.1 | 40 | 16 | 43 | 2 | 52 | 5 | 80 | 20 |
| AD-1223062.1 | 52 | 15 | 57 | 4 | 29 | 7 | 99 | 2 |
| AD-1223063.1 | 40 | 8 | 52 | 7 | 31 | 1 | 91 | 10 |
| AD-1223064.1 | 61 | 13 | 60 | 12 | 60 | 14 | 94 | 5 |
| AD-1223065.1 | 51 | 11 | 42 | 5 | 69 | 19 | 72 | 11 |
| AD-1223066.1 | 30 | 7 | 34 | 2 | 57 | 16 | 73 | 16 |
| AD-1223067.1 | 33 | 0 | 49 | 3 | 83 | 21 | 85 | 14 |
| AD-1223068.1 | 44 | 14 | 49 | 7 | 50 | 3 | 71 | 6 |
| AD-1223069.1 | 48 | 3 | 69 | 1 | 49 | 3 | 111 | 5 |
| AD-1223070.1 | 40 | 16 | 66 | 5 | 44 | 18 | 89 | 7 |
| AD-1223071.1 | 38 | 6 | 48 | 12 | 45 | 13 | 89 | 11 |
| AD-1223072.1 | 55 | 8 | 58 | 4 | 82 | 10 | 78 | 9 |
| AD-1223073.1 | 39 | 5 | 47 | 7 | 96 | 9 | 69 | 5 |
| AD-1223074.1 | 38 | 3 | 43 | 2 | 60 | 10 | 68 | 6 |
| AD-1223075.1 | 35 | 2 | 46 | 2 | 55 | 14 | 66 | 8 |
| AD-1223076.1 | 42 | 9 | 67 | 2 | 30 | 2 | 108 | 21 |
| AD-1223077.1 | 43 | 4 | 75 | 5 | 58 | 20 | 99 | 7 |
| AD-1223078.1 | 63 | 9 | 74 | 10 | 79 | 22 | 91 | 6 |

TABLE 9A-continued

VEGF-A endogenous in vitro multi-dose screen following cellular transfection with one set of exemplary human VEGF-A siRNAs

| DuplexID | 50 nM | StDev | 10 nM | StDev | 1 nM | StDev | 0.1 nM | StDev |
|---|---|---|---|---|---|---|---|---|
| AD-1223079.1 | 76 | 13 | 52 | 2 | 75 | 10 | 92 | 23 |
| AD-1223080.1 | 39 | 3 | 45 | 4 | 70 | 8 | 69 | 11 |
| AD-1223081.1 | 53 | 14 | 57 | 4 | 76 | 4 | 74 | 14 |
| AD-1223082.1 | 34 | 3 | 43 | 3 | 46 | 7 | 60 | 4 |
| AD-1223083.1 | 41 | 11 | 50 | 0 | 47 | 12 | 53 | 4 |
| AD-1223084.1 | 53 | 11 | 58 | 7 | 44 | 9 | 64 | 4 |
| AD-1223085.1 | 46 | 0 | 60 | 1 | 58 | 7 | 91 | 12 |
| AD-1223086.1 | 57 | 11 | 51 | 1 | 73 | 6 | 67 | 9 |
| AD-1223087.1 | 68 | 3 | 71 | 1 | 87 | 5 | 84 | 17 |
| AD-1223088.1 | 64 | 17 | 61 | 12 | 86 | 1 | 88 | 9 |
| AD-1223089.1 | 35 | 5 | 37 | 4 | 50 | 8 | 71 | 7 |
| AD-1223090.1 | 48 | 11 | 51 | 4 | 56 | 7 | 65 | 2 |
| AD-1223091.1 | 45 | 13 | 54 | 5 | 60 | 15 | 63 | 4 |
| AD-1223092.1 | 48 | 18 | 63 | 5 | 83 | 13 | 86 | 7 |
| AD-1223093.1 | 52 | 5 | 48 | 1 | 79 | 18 | 73 | 1 |
| AD-1223094.1 | 40 | 14 | 52 | 10 | 81 | 13 | 76 | 10 |
| AD-1223095.1 | 41 | 11 | 42 | 1 | 66 | 14 | 65 | 7 |
| AD-1223096.1 | 33 | 5 | 51 | 2 | 81 | 23 | 71 | 4 |
| AD-1223097.1 | 31 | 3 | 48 | 6 | 52 | 2 | 77 | 10 |
| AD-1223098.1 | 31 | 8 | 39 | 3 | 41 | 6 | 57 | 1 |
| AD-1223099.1 | 42 | 15 | 58 | 5 | 56 | 8 | 60 | 1 |
| AD-1223100.1 | 35 | 9 | 55 | 7 | 54 | 5 | 62 | 5 |
| AD-1223101.1 | 52 | 3 | 57 | 8 | 111 | 6 | 62 | 8 |
| AD-1223102.1 | 43 | 13 | 62 | 1 | 75 | 13 | 62 | 6 |
| AD-1223103.1 | 54 | 13 | 50 | 8 | 79 | 7 | 72 | 6 |
| AD-1223104.1 | 36 | 17 | 50 | 12 | 50 | 4 | 53 | 5 |
| AD-1223105.1 | 29 | 4 | 46 | 3 | 50 | 12 | 56 | 2 |
| AD-1223106.1 | 43 | 14 | 50 | 9 | 63 | 22 | 54 | 5 |
| AD-1223107.1 | 31 | 3 | 56 | 2 | 63 | 33 | 68 | 3 |
| AD-1223108.1 | 41 | 13 | 53 | 4 | 55 | 11 | 68 | 5 |
| AD-1223109.1 | 58 | 11 | 69 | 12 | 71 | 2 | 73 | 3 |
| AD-1223110.1 | 65 | 10 | 80 | 11 | 87 | 6 | 83 | 7 |
| AD-1223111.1 | 54 | 14 | 58 | 10 | 58 | 15 | 68 | 4 |
| AD-1223112.1 | 52 | 4 | 82 | 2 | 75 | 14 | 78 | 4 |
| AD-1223113.1 | 55 | 11 | 73 | 6 | 81 | 21 | 84 | 1 |
| AD-1223114.1 | 60 | 8 | 66 | 1 | 83 | 16 | 82 | 1 |
| AD-1223115.1 | 81 | 10 | 73 | 6 | 77 | 1 | 84 | 10 |
| AD-1223116.1 | 79 | 3 | 87 | 8 | 79 | 13 | 82 | 6 |
| AD-1223117.1 | 58 | 6 | 92 | 2 | 74 | 18 | 74 | 5 |
| AD-1223118.1 | 38 | 1 | 82 | 2 | 57 | 2 | 71 | 8 |
| AD-1223119.1 | 51 | 9 | 67 | 5 | 79 | 47 | 78 | 8 |
| AD-1223120.1 | 43 | 1 | 72 | 2 | 53 | 10 | 73 | 3 |
| AD-1223121.1 | 46 | 5 | 68 | 5 | 69 | 5 | 67 | 6 |
| AD-1223122.1 | 61 | 26 | 63 | 8 | 75 | 11 | 78 | 7 |
| AD-1223123.1 | 43 | 12 | 59 | 3 | 59 | 8 | 69 | 4 |
| AD-1223124.1 | 66 | 17 | 76 | 3 | 75 | 14 | 67 | 3 |
| AD-1223125.1 | 54 | 15 | 77 | 3 | 68 | 3 | 64 | 4 |
| AD-1223126.1 | 56 | 10 | 70 | 2 | 53 | 2 | 75 | 16 |
| AD-1223127.1 | 47 | 13 | 70 | 4 | 41 | 7 | 62 | 6 |
| AD-1223128.1 | 52 | 3 | 87 | 1 | 50 | 5 | 75 | 1 |
| AD-1223129.1 | 39 | 1 | 65 | 9 | 55 | 11 | 70 | 5 |
| AD-1223130.1 | 43 | 8 | 66 | 4 | 62 | 8 | 71 | 8 |
| AD-1223131.1 | 48 | 14 | 63 | 5 | 55 | 2 | 70 | 3 |
| AD-1223132.1 | 51 | 8 | 74 | 6 | 75 | 13 | 72 | 2 |
| AD-1223133.1 | 37 | 2 | 61 | 0 | 60 | 4 | 70 | 6 |
| AD-1223134.1 | 41 | 3 | 69 | 2 | 55 | 1 | 71 | 9 |
| AD-1223135.1 | 59 | 20 | 85 | 10 | 54 | 8 | 73 | 4 |
| AD-1223136.1 | 79 | 12 | 134 | 13 | 62 | 9 | 118 | 26 |
| AD-1223137.1 | 65 | 7 | 99 | 30 | 69 | 10 | 127 | 19 |
| AD-1223138.1 | 77 | 19 | 100 | 23 | 68 | 6 | 112 | 28 |
| AD-1223139.1 | 53 | 1 | 127 | 15 | 60 | 15 | 106 | 20 |
| AD-1223140.1 | 59 | 22 | 67 | 7 | 46 | 8 | 98 | 23 |
| AD-1223141.1 | 50 | 6 | 69 | 4 | 52 | 19 | 73 | 22 |
| AD-1223142.1 | 49 | 3 | 63 | 5 | 42 | 11 | 72 | 6 |
| AD-1223143.1 | 45 | 10 | 56 | 11 | 52 | 13 | 68 | 14 |
| AD-1223144.1 | 50 | 8 | 54 | 11 | 60 | 2 | 115 | 5 |
| AD-1223145.1 | 49 | 4 | 74 | 13 | 62 | 19 | 90 | 2 |
| AD-1223146.1 | 81 | 3 | 97 | 35 | 111 | 9 | 107 | 21 |
| AD-1223147.1 | 65 | 15 | 71 | 18 | 62 | 9 | 106 | 13 |
| AD-1223148.1 | 63 | 8 | 74 | 12 | 63 | 11 | 100 | 31 |
| AD-1223149.1 | 49 | 6 | 59 | 13 | 51 | 10 | 100 | 26 |
| AD-1223150.1 | 49 | 2 | 67 | 14 | 47 | 16 | 89 | 21 |
| AD-1223151.1 | 51 | 1 | 62 | 11 | 42 | 5 | 98 | 6 |
| AD-1223152.1 | 67 | 9 | 90 | 20 | 63 | 11 | 123 | 11 |
| AD-1223153.1 | 77 | 3 | 88 | 18 | 109 | 9 | 126 | 12 |

TABLE 9A-continued

VEGF-A endogenous in vitro multi-dose screen following cellular transfection with one set of exemplary human VEGF-A siRNAs

| DuplexID | 50 nM | StDev | 10 nM | StDev | 1 nM | StDev | 0.1 nM | StDev |
|---|---|---|---|---|---|---|---|---|
| AD-1223154.1 | 53 | 9 | 46 | 2 | 70 | 8 | 87 | 3 |
| AD-1223155.1 | 55 | 15 | 40 | 4 | 53 | 15 | 129 | 41 |
| AD-1223156.1 | 54 | 9 | 48 | 3 | 48 | 12 | 91 | 13 |
| AD-1223157.1 | 49 | 8 | 53 | 14 | 52 | 11 | 92 | 13 |
| AD-1223158.1 | 45 | 3 | 49 | 9 | 40 | 9 | 84 | 9 |
| AD-1223159.1 | 42 | 7 | 77 | 29 | 59 | 13 | 109 | 7 |
| AD-1223160.1 | 55 | 8 | 55 | 4 | 98 | 7 | 122 | 18 |
| AD-1223161.1 | 49 | 10 | 57 | 9 | 66 | 18 | 118 | 16 |
| AD-1223162.1 | 73 | 5 | 59 | 6 | 52 | 2 | 91 | 13 |
| AD-1223163.1 | 57 | 16 | 59 | 7 | 61 | 13 | 94 | 20 |
| AD-1223164.1 | 58 | 18 | 70 | 8 | 54 | 3 | 120 | 9 |
| AD-1223165.1 | 49 | 13 | 65 | 2 | 50 | 6 | 98 | 6 |
| AD-1223166.1 | 70 | 13 | 72 | 14 | 92 | 9 | 125 | 21 |
| AD-1223167.1 | 78 | 8 | 71 | 9 | 101 | 34 | 119 | 26 |
| AD-1223168.1 | 75 | 17 | 77 | 10 | 98 | 18 | 115 | 15 |
| AD-1223169.1 | 87 | 3 | 57 | 2 | 76 | 27 | 133 | 23 |
| AD-1223170.1 | 87 | 11 | 73 | 12 | 93 | 19 | 85 | 8 |
| AD-1223171.1 | 67 | 20 | 72 | 31 | 70 | 4 | 96 | 12 |
| AD-1223172.1 | 41 | 10 | 44 | 4 | 54 | 9 | 93 | 5 |
| AD-1223173.1 | 62 | 14 | 81 | 21 | 58 | 24 | 116 | 16 |
| AD-1223174.1 | 60 | 14 | 65 | 2 | 96 | 2 | 101 | 9 |
| AD-1223175.1 | 80 | 29 | 61 | 6 | 91 | 19 | 98 | 15 |
| AD-1223176.1 | 77 | 4 | 85 | 6 | 123 | 19 | 109 | 22 |
| AD-1223177.1 | 72 | 14 | 51 | 6 | 70 | 17 | 92 | 1 |
| AD-1223178.1 | 80 | 3 | 77 | 8 | 72 | 16 | 96 | 11 |
| AD-1223179.1 | 82 | 14 | 111 | 9 | 66 | 9 | 81 | 15 |
| AD-1223180.1 | 47 | 9 | 45 | 2 | 54 | 15 | 81 | 12 |
| AD-1223181.1 | 82 | 8 | 76 | 11 | 74 | 17 | 131 | 27 |
| AD-1223182.1 | 58 | 11 | 56 | 13 | 72 | 15 | 80 | 7 |
| AD-1223183.1 | 79 | 20 | 55 | 4 | 94 | 11 | 90 | 9 |
| AD-1223184.1 | 39 | 3 | 38 | 1 | 51 | 4 | 72 | 5 |
| AD-1223185.1 | 63 | 4 | 52 | 10 | 48 | 5 | 76 | 8 |
| AD-1223186.1 | 56 | 17 | 54 | 11 | 48 | 11 | 70 | 4 |
| AD-1223187.1 | 37 | 2 | 39 | 3 | 45 | 14 | 74 | 9 |
| AD-1223188.1 | 32 | 6 | 42 | 7 | 34 | 2 | 68 | 3 |
| AD-1223189.1 | 43 | 14 | 41 | 5 | 56 | 1 | 65 | 12 |
| AD-1223190.1 | 38 | 7 | 41 | 3 | 53 | 14 | 53 | 1 |
| AD-1223191.1 | 55 | 13 | 41 | 7 | 50 | 2 | 56 | 12 |
| AD-1223192.1 | 33 | 3 | 38 | 5 | 43 | 6 | 57 | 6 |
| AD-1223193.1 | 34 | 2 | 30 | 2 | 33 | 9 | 44 | 9 |
| AD-1223194.1 | 45 | 11 | 33 | 6 | 25 | 5 | 48 | 3 |
| AD-1223195.1 | 50 | 19 | 31 | 4 | 39 | 13 | 51 | 4 |
| AD-1223196.1 | 42 | 2 | 29 | 6 | 29 | 11 | 62 | 4 |
| AD-1223197.1 | 42 | 2 | 29 | 0 | 26 | 1 | 59 | 12 |
| AD-1223198.1 | 54 | 10 | 41 | 10 | 61 | 2 | 79 | 8 |
| AD-1223199.1 | 39 | 4 | 36 | 6 | 52 | 16 | 70 | 4 |
| AD-1223200.1 | 35 | 11 | 31 | 2 | 32 | 12 | 57 | 3 |
| AD-1223201.1 | 46 | 18 | 36 | 7 | 32 | 1 | 55 | 7 |
| AD-1223202.1 | 38 | 8 | 31 | 3 | 39 | 3 | 66 | 6 |
| AD-1223203.1 | 39 | 6 | 39 | 6 | 34 | 9 | 66 | 1 |
| AD-1223204.1 | 45 | 4 | 40 | 7 | 45 | 5 | 78 | 2 |
| AD-1223205.1 | 60 | 14 | 54 | 15 | 58 | 4 | 72 | 10 |
| AD-1223206.1 | 43 | 11 | 31 | 5 | 40 | 3 | 57 | 5 |
| AD-1223207.1 | 73 | 2 | 65 | 10 | 57 | 10 | 77 | 12 |
| AD-1223208.1 | 73 | 22 | 68 | 8 | 57 | 10 | 73 | 8 |
| AD-1223209.1 | 48 | 9 | 44 | 10 | 45 | 5 | 73 | 15 |
| AD-1223210.1 | 46 | 9 | 34 | 2 | 43 | 16 | 84 | 9 |
| AD-1223211.1 | 26 | 4 | 40 | 12 | 39 | 7 | 63 | 3 |
| AD-1223212.1 | 46 | 10 | 33 | 3 | 49 | 11 | 68 | 1 |
| AD-1223213.1 | 58 | 6 | 36 | 4 | 46 | 3 | 57 | 2 |
| AD-1223214.1 | 34 | 1 | 35 | 1 | 43 | 6 | 62 | 8 |
| AD-1223215.1 | 41 | 9 | 33 | 6 | 39 | 8 | 61 | 9 |
| AD-1223216.1 | 43 | 8 | 31 | 2 | 47 | 13 | 59 | 4 |
| AD-1223217.1 | 41 | 6 | 39 | 2 | 38 | 7 | 66 | 7 |
| AD-1223218.1 | 31 | 6 | 36 | 4 | 43 | 10 | 65 | 7 |
| AD-1223219.1 | 35 | 7 | 47 | 7 | 48 | 4 | 68 | 1 |
| AD-1223220.1 | 36 | 9 | 39 | 3 | 40 | 11 | 62 | 3 |
| AD-1223221.1 | 43 | 13 | 31 | 0 | 39 | 13 | 58 | 6 |
| AD-1223222.1 | 65 | 27 | 50 | 7 | 57 | 10 | 68 | 9 |
| AD-1223223.1 | 45 | 2 | 39 | 5 | 47 | 2 | 66 | 11 |
| AD-1223224.1 | 32 | 4 | 33 | 5 | 40 | 6 | 60 | 2 |
| AD-1223225.1 | 35 | 8 | 37 | 3 | 31 | 5 | 70 | 9 |
| AD-1223226.1 | 93 | 9 | 62 | 10 | 55 | 5 | 74 | 16 |
| AD-1223227.1 | 100 | 15 | 77 | 12 | 69 | 6 | 69 | 5 |
| AD-1223228.1 | 83 | 5 | 44 | 7 | 44 | 5 | 55 | 3 |

TABLE 9A-continued

VEGF-A endogenous in vitro multi-dose screen following cellular transfection with one set of exemplary human VEGF-A siRNAs

| DuplexID | 50 nM | StDev | 10 nM | StDev | 1 nM | StDev | 0.1 nM | StDev |
|---|---|---|---|---|---|---|---|---|
| AD-1223229.1 | 101 | 29 | 59 | 9 | 56 | 7 | 62 | 11 |
| AD-1223230.1 | 85 | 16 | 45 | 6 | 48 | 2 | 52 | 8 |
| AD-1223231.1 | 97 | 18 | 56 | 2 | 57 | 3 | 68 | 12 |
| AD-1223232.1 | 110 | 15 | 79 | 9 | 60 | 2 | 54 | 1 |
| AD-1223233.1 | 95 | 9 | 62 | 4 | 60 | 9 | 58 | 3 |
| AD-1223234.1 | 105 | 8 | 68 | 14 | 72 | 1 | 78 | 13 |
| AD-1223235.1 | 81 | 5 | 64 | 14 | 69 | 12 | 67 | 3 |
| AD-1223236.1 | 83 | 12 | 53 | 6 | 63 | 5 | 90 | 15 |
| AD-1223237.1 | 146 | 33 | 95 | 26 | 82 | 15 | 92 | 16 |
| AD-1223238.1 | 72 | 5 | 68 | 17 | 60 | 5 | 69 | 7 |
| AD-1223239.1 | 75 | 17 | 49 | 3 | 51 | 5 | 67 | 5 |
| AD-1223240.1 | 63 | 2 | 59 | 10 | 53 | 2 | 55 | 9 |
| AD-1223241.1 | 78 | 18 | 55 | 10 | 49 | 5 | 53 | 7 |
| AD-1223242.1 | 77 | 10 | 57 | 6 | 64 | 8 | 70 | 6 |
| AD-1223243.1 | 108 | 1 | 60 | 10 | 70 | 2 | 66 | 11 |
| AD-1223244.1 | 50 | 9 | 62 | 9 | 56 | 9 | 75 | 15 |
| AD-1223245.1 | 59 | 0 | 63 | 12 | 72 | 1 | 79 | 5 |
| AD-1223246.1 | 52 | 4 | 51 | 9 | 44 | 4 | 71 | 9 |
| AD-1223247.1 | 68 | 9 | 58 | 4 | 49 | 3 | 61 | 9 |
| AD-1223248.1 | 80 | 9 | 58 | 8 | 50 | 5 | 54 | 7 |
| AD-1223249.1 | 81 | 16 | 69 | 4 | 96 | 25 | 63 | 13 |
| AD-1223250.1 | 77 | 16 | 72 | 11 | 123 | 20 | 65 | 14 |
| AD-1223251.1 | 58 | 15 | 65 | 7 | 88 | 7 | 60 | 9 |
| AD-1223252.1 | 69 | 12 | 60 | 8 | 80 | 12 | 80 | 21 |
| AD-1223253.1 | 68 | 31 | 48 | 5 | 67 | 13 | 53 | 1 |
| AD-1223254.1 | 49 | 7 | 56 | 12 | 84 | 0 | 54 | 7 |
| AD-1223255.1 | 46 | 5 | 50 | 8 | 59 | 6 | 46 | 8 |
| AD-1223256.1 | 63 | 21 | 53 | 5 | 75 | 16 | 73 | 2 |
| AD-1223257.1 | 74 | 34 | 70 | 3 | 88 | 14 | 71 | 11 |
| AD-1223258.1 | 68 | 19 | 73 | 14 | 91 | 17 | 104 | 7 |
| AD-1223259.1 | 92 | 37 | 106 | 2 | 114 | 20 | 101 | 3 |
| AD-1223260.1 | 59 | 12 | 79 | 8 | 79 | 16 | 99 | 13 |
| AD-1223261.1 | 47 | 13 | 66 | 15 | 86 | 8 | 77 | 15 |
| AD-1223262.1 | 39 | 6 | 45 | 4 | 68 | 12 | 58 | 4 |
| AD-1223263.1 | 39 | 3 | 44 | 2 | 64 | 1 | 44 | 9 |
| AD-1223264.1 | 42 | 10 | 43 | 3 | 79 | 20 | 59 | 8 |
| AD-1223265.1 | 58 | 11 | 56 | 10 | 101 | 7 | 88 | 8 |
| AD-1223266.1 | 49 | 5 | 48 | 7 | 68 | 5 | 72 | 6 |
| AD-1223267.1 | 79 | 30 | 70 | 14 | 95 | 11 | 102 | 19 |
| AD-1223268.1 | 54 | 7 | 64 | 7 | 83 | 9 | 96 | 6 |
| AD-1223269.1 | 45 | 13 | 49 | 8 | 78 | 16 | 80 | 9 |
| AD-1223270.1 | 53 | 14 | 70 | 16 | 76 | 4 | 70 | 6 |
| AD-1223271.1 | 55 | 17 | 61 | 5 | 88 | 14 | 83 | 13 |
| AD-1223272.1 | 57 | 28 | 60 | 6 | 75 | 9 | 77 | 6 |
| AD-1223273.1 | 33 | 3 | 56 | 7 | 77 | 17 | 94 | 6 |
| AD-1223274.1 | 49 | 5 | 67 | 14 | 81 | 9 | 110 | 17 |
| AD-1223275.1 | 53 | 4 | 63 | 11 | 67 | 6 | 115 | 15 |
| AD-1223276.1 | 53 | 3 | 80 | 15 | 89 | 6 | 98 | 9 |
| AD-1223277.1 | 41 | 7 | 67 | 14 | 75 | 6 | 82 | 19 |
| AD-1223278.1 | 47 | 2 | 60 | 7 | 69 | 6 | 58 | 7 |
| AD-1223279.1 | 57 | 9 | 64 | 8 | 93 | 12 | 102 | 24 |
| AD-1223280.1 | 59 | 8 | 72 | 2 | 86 | 11 | 100 | 9 |
| AD-1223281.1 | 52 | 5 | 66 | 8 | 86 | 17 | 95 | 13 |
| AD-1223282.1 | 35 | 4 | 56 | 9 | 67 | 4 | 103 | 18 |
| AD-1223283.1 | 36 | 5 | 43 | 3 | 46 | 2 | 97 | 3 |
| AD-1223284.1 | 32 | 1 | 51 | 9 | 60 | 15 | 65 | 7 |
| AD-1223285.1 | 37 | 4 | 64 | 19 | 57 | 7 | 76 | 6 |
| AD-1223286.1 | 37 | 7 | 38 | 6 | 51 | 7 | 56 | 8 |
| AD-1223287.1 | 36 | 8 | 40 | 5 | 60 | 8 | 73 | 23 |
| AD-1223288.1 | 46 | 6 | 64 | 10 | 87 | 5 | 77 | 6 |
| AD-1223289.1 | 41 | 7 | 61 | 7 | 78 | 1 | 119 | 2 |
| AD-1223290.1 | 46 | 6 | 56 | 5 | 76 | 12 | 98 | 9 |
| AD-1223291.1 | 41 | 4 | 68 | 9 | 81 | 9 | 94 | 15 |
| AD-1223292.1 | 39 | 10 | 84 | 36 | 71 | 4 | 73 | 9 |
| AD-1223293.1 | 47 | 7 | 53 | 1 | 65 | 11 | 59 | 7 |
| AD-1223294.1 | 38 | 1 | 53 | 4 | 59 | 1 | 61 | 20 |
| AD-1223295.1 | 58 | 3 | 67 | 7 | 81 | 8 | 106 | 8 |
| AD-1223296.1 | 72 | 1 | 87 | 10 | 87 | 14 | 113 | 19 |
| AD-1223297.1 | 54 | 9 | 73 | 11 | 78 | 9 | 99 | 2 |
| AD-1223298.1 | 55 | 17 | 65 | 10 | 75 | 9 | 94 | 11 |
| AD-1223299.1 | 58 | 9 | 78 | 8 | 85 | 12 | 73 | 12 |
| AD-1223300.1 | 54 | 6 | 67 | 7 | 79 | 20 | 70 | 9 |
| AD-1223301.1 | 44 | 6 | 61 | 4 | 66 | 4 | 58 | 8 |
| AD-1223302.1 | 44 | 6 | 67 | 10 | 77 | 3 | 75 | 9 |
| AD-1223303.1 | 37 | 2 | 70 | 9 | 79 | 8 | 74 | 14 |

TABLE 9A-continued

| VEGF-A endogenous in vitro multi-dose screen following cellular transfection with one set of exemplary human VEGF-A siRNAs | | | | | | | | |
|---|---|---|---|---|---|---|---|---|
| DuplexID | 50 nM | StDev | 10 nM | StDev | 1 nM | StDev | 0.1 nM | StDev |
| AD-1223304.1 | 49 | 3 | 71 | 8 | 75 | 9 | 111 | 13 |
| AD-1223305.1 | 42 | 4 | 53 | 6 | 71 | 11 | 79 | 9 |
| AD-1223306.1 | 39 | 1 | 60 | 12 | 64 | 4 | 71 | 9 |
| AD-1223307.1 | 37 | 2 | 62 | 5 | 70 | 17 | 76 | 4 |
| AD-1223308.1 | 33 | 1 | 51 | 12 | 57 | 15 | 58 | 6 |
| AD-1223309.1 | 45 | 10 | 62 | 14 | 61 | 3 | 63 | 14 |
| AD-1223310.1 | 41 | 6 | 54 | 14 | 62 | 2 | 62 | 20 |
| AD-1223311.1 | 54 | 5 | 66 | 11 | 72 | 16 | 66 | 12 |
| AD-1223312.1 | 38 | 7 | 39 | 2 | 54 | 8 | 67 | 19 |
| AD-1223313.1 | 29 | 2 | 40 | 2 | 57 | 6 | 51 | 3 |
| AD-1223314.1 | 33 | 9 | 43 | 1 | 47 | 7 | 58 | 8 |
| AD-1223315.1 | 28 | 1 | 40 | 4 | 48 | 11 | 61 | 15 |

The results of the multi-dose screen in primary human hepatocytes allowed to freely uptake one set of exemplary human VEGF-A siRNAs is shown in Table 9B (correspond to siRNAs in Table 8A and 8B) The multi-dose experiments were performed at 500 nM, 100 nM, 10 nM, and 1 nM final duplex concentrations and the data are expressed as percent message remaining relative to non-targeting control.

Of the exemplary siRNA duplexes evaluated in Table 9B, 2 achieved a knockdown of VEGF-A of ≥80%, 53 achieved a knockdown of VEGF-A of ≥60%, and 239 achieved a knockdown of VEGF-A of ≥30% when administered at the 500 nM concentration.

Of the exemplary siRNA duplexes evaluated in Table 9B, 4 achieved a knockdown of VEGF-A of ≥70%, 33 achieved a knockdown of VEGF-A of ≥60%, and 235 achieved a knockdown of VEGF-A of ≥30% when administered at the 100 nM concentration.

Of the exemplary siRNA duplexes evaluated in Table 9B, 3 achieved a knockdown of VEGF-A of ≥60%, 52 achieved a knockdown of VEGF-A of ≥40%, and 113 achieved a knockdown of VEGF-A of ≥30% when administered at the 10 nM concentration.

Of the exemplary siRNA duplexes evaluated in Table 9B, 13 achieved a knockdown of VEGF-A of ≥50%, 88 achieved a knockdown of VEGF-A of ≥30%, and 146 achieved a knockdown of VEGF-A of ≥20% when administered at the 1 nM concentration.

TABLE 9B

| VEGF-A endogenous in vitro multi-dose screen following free uptake of one set of exemplary human VEGF-A siRNAs | | | | | | | | |
|---|---|---|---|---|---|---|---|---|
| DuplexID | 500 nM | StDev | 100 nM | StDev | 10 nM | StDev | 1 nM | StDev |
| AD-1222866.1 | 114 | 23 | 103 | 40 | 117 | 14 | 117 | 9 |
| AD-1222867.1 | 114 | 11 | 176 | 58 | 104 | 9 | 134 | 24 |
| AD-1222868.1 | 140 | 19 | 168 | 85 | 123 | 18 | 134 | 6 |
| AD-1222869.1 | 110 | 12 | 149 | 62 | 149 | 23 | 131 | 25 |
| AD-1222870.1 | 107 | 20 | 191 | 9 | 138 | 24 | 124 | 15 |
| AD-1222871.1 | 102 | 11 | 140 | 48 | 130 | 13 | 138 | 18 |
| AD-1222872.1 | 95 | 20 | 112 | 27 | 112 | 15 | 120 | 9 |
| AD-1222873.1 | 73 | 17 | 94 | 10 | 107 | 1 | 110 | 6 |
| AD-1222874.1 | 148 | 27 | 109 | 6 | 137 | 5 | 113 | 9 |
| AD-1222875.1 | 132 | 7 | 93 | 4 | 161 | 25 | 139 | 11 |
| AD-1222876.1 | 142 | 12 | 141 | 1 | 131 | 11 | 145 | 8 |
| AD-1222877.1 | 119 | 2 | 111 | 3 | 176 | 15 | 132 | 4 |
| AD-1222878.1 | 160 | 43 | 128 | 10 | 139 | 8 | 128 | 16 |
| AD-1222879.1 | 150 | 21 | 119 | 13 | 139 | 22 | 116 | 16 |
| AD-1222880.1 | 107 | 22 | 113 | 9 | 145 | 21 | 120 | 7 |
| AD-1222881.1 | 90 | 28 | 91 | 4 | 106 | 2 | 113 | 7 |
| AD-1222882.1 | 151 | 4 | 118 | 7 | 136 | 4 | 114 | 4 |
| AD-1222883.1 | 143 | 13 | 120 | 11 | 147 | 12 | 129 | 8 |
| AD-1222884.1 | 137 | 22 | 135 | 23 | 174 | 18 | 120 | 12 |
| AD-1222885.1 | 162 | 16 | 130 | 13 | 169 | 15 | 120 | 4 |
| AD-1222886.1 | 128 | 26 | 114 | 1 | 155 | 16 | 107 | 14 |
| AD-1222887.1 | 143 | 32 | 128 | 24 | 124 | 10 | 116 | 13 |
| AD-1222888.1 | 77 | 7 | 113 | 2 | 123 | 1 | 116 | 10 |
| AD-1222889.1 | 142 | 11 | 92 | 18 | 143 | 31 | 113 | 13 |
| AD-1222890.1 | 160 | 11 | 129 | 12 | 166 | 27 | 133 | 2 |
| AD-1222891.1 | 138 | 12 | 126 | 6 | 173 | 27 | 136 | 17 |
| AD-1222892.1 | 136 | 7 | 127 | 9 | 153 | 27 | 106 | 7 |
| AD-1222893.1 | 111 | 11 | 118 | 6 | 141 | 10 | 130 | 16 |
| AD-1222894.1 | 111 | 12 | 118 | 10 | 119 | 24 | 123 | 2 |
| AD-1222895.1 | 96 | 8 | 103 | 0 | 121 | 27 | 122 | 18 |
| AD-1222896.1 | 142 | 23 | 97 | 18 | 134 | 6 | 113 | 3 |
| AD-1222897.1 | 155 | 13 | 126 | 6 | 157 | 21 | 129 | 12 |
| AD-1222898.1 | 152 | 53 | 124 | 18 | 141 | 19 | 111 | 10 |
| AD-1222899.1 | 138 | 21 | 110 | 9 | 147 | 28 | 120 | 1 |
| AD-1222900.1 | 123 | 15 | 115 | 20 | 166 | 13 | 108 | 8 |

TABLE 9B-continued

VEGF-A endogenous in vitro multi-dose screen following free uptake of one set of exemplary human VEGF-A siRNAs

| DuplexID | 500 nM | StDev | 100 nM | StDev | 10 nM | StDev | 1 nM | StDev |
|---|---|---|---|---|---|---|---|---|
| AD-1222901.1 | 106 | 6 | 116 | 6 | 161 | 17 | 105 | 15 |
| AD-1222902.1 | 86 | 7 | 106 | 12 | 126 | 28 | 91 | 3 |
| AD-1222903.1 | 84 | 5 | 95 | 2 | 138 | 6 | 112 | 23 |
| AD-1222904.1 | 115 | 19 | 92 | 3 | 127 | 2 | 103 | 7 |
| AD-1222905.1 | 137 | 10 | 129 | 11 | 132 | 22 | 107 | 3 |
| AD-1222906.1 | 122 | 23 | 142 | 8 | 131 | 19 | 119 | 15 |
| AD-1222907.1 | 126 | 35 | 120 | 11 | 143 | 22 | 103 | 3 |
| AD-1222908.1 | 113 | 12 | 108 | 7 | 155 | 32 | 91 | 10 |
| AD-1222909.1 | 104 | 2 | 106 | 13 | 134 | 23 | 106 | 2 |
| AD-1222910.1 | 79 | 1 | 102 | 4 | 104 | 14 | 82 | 9 |
| AD-1222911.1 | 114 | 8 | 106 | 22 | 98 | 11 | 102 | 6 |
| AD-1222912.1 | 107 | 4 | 120 | 14 | 119 | 4 | 114 | 13 |
| AD-1222913.1 | 126 | 31 | 115 | 5 | 109 | 13 | 103 | 11 |
| AD-1222914.1 | 109 | 17 | 118 | 20 | 116 | 5 | 108 | 18 |
| AD-1222915.1 | 88 | 3 | 95 | 11 | 120 | 21 | 88 | 14 |
| AD-1222916.1 | 91 | 12 | 98 | 13 | 114 | 27 | 99 | 18 |
| AD-1222917.1 | 70 | 1 | 93 | 6 | 88 | 16 | 86 | 2 |
| AD-1222918.1 | 93 | 6 | 104 | 6 | 85 | 3 | 101 | 5 |
| AD-1222920.1 | 88 | 12 | 90 | 10 | 95 | 6 | 100 | 8 |
| AD-1222921.1 | 109 | 19 | 108 | 5 | 111 | 27 | 105 | 18 |
| AD-1222922.1 | 91 | 20 | 87 | 5 | 124 | 12 | 104 | 10 |
| AD-1222923.1 | 70 | 19 | 91 | 6 | 109 | 11 | 82 | 2 |
| AD-1222924.1 | 85 | 14 | 103 | 13 | 107 | 14 | 83 | 17 |
| AD-1222925.1 | 82 | 22 | 97 | 14 | 88 | 12 | 78 | 4 |
| AD-1222926.1 | 103 | 9 | 86 | 14 | 92 | 18 | 93 | 13 |
| AD-1222927.1 | 73 | 8 | 59 | 11 | 78 | 16 | 80 | 2 |
| AD-1222928.1 | 80 | 1 | 71 | 11 | 85 | 9 | 94 | 7 |
| AD-1222929.1 | 80 | 8 | 85 | 3 | 80 | 5 | 94 | 17 |
| AD-1222930.1 | 76 | 6 | 85 | 6 | 97 | 11 | 74 | 3 |
| AD-1222931.1 | 79 | 18 | 89 | 9 | 90 | 15 | 74 | 10 |
| AD-1222932.1 | 85 | 1 | 81 | 16 | 76 | 3 | 57 | 7 |
| AD-1222933.1 | 62 | 2 | 64 | 4 | 77 | 5 | 67 | 10 |
| AD-1222934.1 | 43 | 3 | 45 | 9 | 63 | 6 | 62 | 1 |
| AD-1222935.1 | 43 | 3 | 53 | 12 | 73 | 2 | 78 | 2 |
| AD-1222936.1 | 66 | 11 | 56 | 11 | 65 | 10 | 75 | 6 |
| AD-1222937.1 | 72 | 13 | 75 | 5 | 90 | 16 | 72 | 5 |
| AD-1222938.1 | 65 | 6 | 71 | 14 | 78 | 11 | 81 | 8 |
| AD-1222939.1 | 55 | 6 | 70 | 4 | 77 | 10 | 85 | 7 |
| AD-1222940.1 | 61 | 16 | 44 | 1 | 71 | 6 | 74 | 2 |
| AD-1222941.1 | 44 | 7 | 42 | 10 | 51 | 5 | 43 | 4 |
| AD-1222942.1 | 31 | 0 | 37 | 3 | 64 | 8 | 59 | 6 |
| AD-1222943.1 | 58 | 7 | 54 | 11 | 65 | 2 | 58 | 11 |
| AD-1222944.1 | 46 | 6 | 49 | 6 | 69 | 7 | 63 | 12 |
| AD-1222945.1 | 57 | 6 | 62 | 14 | 69 | 11 | 55 | 11 |
| AD-1222946.1 | 50 | 5 | 60 | 16 | 55 | 2 | 57 | 3 |
| AD-1222947.1 | 37 | 4 | 43 | 9 | 59 | 5 | 62 | 9 |
| AD-1222948.1 | 60 | 1 | 63 | 16 | 61 | 13 | 57 | 1 |
| AD-1222949.1 | 40 | 7 | 41 | 12 | 61 | 7 | 46 | 1 |
| AD-1222950.1 | 36 | 4 | 36 | 7 | 55 | 1 | 44 | 4 |
| AD-1222951.1 | 34 | 5 | 32 | 6 | 52 | 4 | 41 | 5 |
| AD-1222952.1 | 61 | 6 | 48 | 14 | 65 | 7 | 44 | 8 |
| AD-1222953.1 | 34 | 6 | 30 | 5 | 51 | 6 | 43 | 1 |
| AD-1222954.1 | 15 | 2 | 25 | 5 | 47 | 4 | 36 | 1 |
| AD-1222955.1 | 19 | 3 | 26 | 5 | 52 | 8 | 40 | 1 |
| AD-1222956.1 | 64 | 8 | 72 | 5 | 110 | 6 | 123 | 6 |
| AD-1222957.1 | 132 | 19 | 98 | 5 | 109 | 14 | 122 | 3 |
| AD-1222958.1 | 72 | 10 | 96 | 7 | 120 | 26 | 133 | 3 |
| AD-1222959.1 | 76 | 13 | 88 | 2 | 119 | 29 | 125 | 4 |
| AD-1222960.1 | 71 | 3 | 123 | 14 | 136 | 39 | 141 | 8 |
| AD-1222961.1 | 112 | 10 | 119 | 10 | 128 | 41 | 115 | 1 |
| AD-1222962.1 | 88 | 4 | 97 | 16 | 120 | 31 | 142 | 12 |
| AD-1222963.1 | 81 | 13 | 83 | 7 | 129 | 23 | 123 | 2 |
| AD-1222964.1 | 90 | 6 | 89 | 2 | 130 | 39 | 134 | 10 |
| AD-1222965.1 | 141 | 16 | 118 | 6 | 118 | 10 | 145 | 19 |
| AD-1222966.1 | 105 | 8 | 119 | 9 | 113 | 11 | 145 | 20 |
| AD-1222967.1 | 127 | 12 | 126 | 3 | 116 | 6 | 143 | 6 |
| AD-1222968.1 | 128 | 7 | 144 | 9 | 120 | 19 | 138 | 11 |
| AD-1222969.1 | 114 | 12 | 121 | 17 | 110 | 6 | 126 | 7 |
| AD-1222970.1 | 58 | 6 | 92 | 7 | 104 | 10 | 120 | 5 |
| AD-1222971.1 | 81 | 6 | 109 | 9 | 106 | 7 | 127 | 8 |
| AD-1222972.1 | 95 | 21 | 76 | 5 | 100 | 11 | 119 | 12 |
| AD-1222973.1 | 97 | 12 | 87 | 2 | 101 | 34 | 143 | 1 |
| AD-1222974.1 | 119 | 8 | 122 | 8 | 105 | 11 | 116 | 5 |
| AD-1222975.1 | 115 | 11 | 113 | 8 | 102 | 9 | 130 | 10 |
| AD-1222976.1 | 97 | 22 | 100 | 13 | 91 | 8 | 106 | 11 |

TABLE 9B-continued

VEGF-A endogenous in vitro multi-dose screen following free uptake of one set of exemplary human VEGF-A siRNAs

| DuplexID | 500 nM | StDev | 100 nM | StDev | 10 nM | StDev | 1 nM | StDev |
|---|---|---|---|---|---|---|---|---|
| AD-1222977.1 | 90 | 13 | 86 | 12 | 98 | 5 | 109 | 4 |
| AD-1222978.1 | 66 | 7 | 77 | 2 | 104 | 12 | 136 | 1 |
| AD-1222979.1 | 92 | 5 | 93 | 4 | 98 | 1 | 125 | 4 |
| AD-1222980.1 | 98 | 1 | 117 | 12 | 103 | 3 | 133 | 9 |
| AD-1222981.1 | 147 | 17 | 147 | 19 | 110 | 10 | 119 | 10 |
| AD-1222982.1 | 95 | 10 | 99 | 16 | 92 | 10 | 114 | 6 |
| AD-1222983.1 | 77 | 9 | 86 | 14 | 86 | 3 | 108 | 10 |
| AD-1222984.1 | 73 | 15 | 93 | 5 | 78 | 3 | 108 | 10 |
| AD-1222985.1 | 89 | 12 | 103 | 20 | 101 | 22 | 119 | 10 |
| AD-1222986.1 | 65 | 1 | 75 | 1 | 97 | 8 | 120 | 10 |
| AD-1222987.1 | 105 | 10 | 92 | 6 | 106 | 9 | 122 | 6 |
| AD-1222988.1 | 74 | 0 | 79 | 1 | 90 | 11 | 128 | 7 |
| AD-1222989.1 | 116 | 1 | 99 | 7 | 112 | 29 | 114 | 11 |
| AD-1222990.1 | 87 | 1 | 95 | 8 | 97 | 15 | 116 | 7 |
| AD-1222991.1 | 81 | 11 | 95 | 14 | 100 | 10 | 109 | 6 |
| AD-1222992.1 | 78 | 10 | 100 | 5 | 89 | 7 | 109 | 6 |
| AD-1222993.1 | 78 | 3 | 111 | 9 | 105 | 10 | 124 | 7 |
| AD-1222994.1 | 78 | 12 | 76 | 0 | 99 | 13 | 116 | 16 |
| AD-1222995.1 | 103 | 18 | 93 | 0 | 97 | 6 | 120 | 3 |
| AD-1222996.1 | 108 | 4 | 122 | 17 | 104 | 5 | 114 | 11 |
| AD-1222997.1 | 108 | 12 | 96 | 3 | 94 | 8 | 113 | 15 |
| AD-1222998.1 | 101 | 11 | 77 | 3 | 87 | 7 | 106 | 2 |
| AD-1222999.1 | 94 | 8 | 99 | 8 | 116 | 8 | 105 | 5 |
| AD-1223000.1 | 80 | 14 | 97 | 25 | 80 | 10 | 97 | 8 |
| AD-1223001.1 | 79 | 10 | 84 | 8 | 108 | 17 | 111 | 5 |
| AD-1223002.1 | 95 | 15 | 93 | 12 | 109 | 11 | 120 | 16 |
| AD-1223003.1 | 97 | 9 | 105 | 9 | 105 | 10 | 115 | 8 |
| AD-1223004.1 | 64 | 9 | 80 | 9 | 93 | 16 | 101 | 10 |
| AD-1223005.1 | 85 | 11 | 104 | 1 | 89 | 16 | 93 | 11 |
| AD-1223006.1 | 70 | 1 | 83 | 9 | 82 | 5 | 96 | 1 |
| AD-1223007.1 | 76 | 2 | 86 | 15 | 88 | 20 | 100 | 8 |
| AD-1223008.1 | 37 | 3 | 66 | 9 | 88 | 2 | 110 | 2 |
| AD-1223009.1 | 57 | 9 | 73 | 10 | 83 | 9 | 102 | 4 |
| AD-1223010.1 | 73 | 7 | 82 | 6 | 108 | 19 | 109 | 9 |
| AD-1223011.1 | 71 | 2 | 86 | 16 | 89 | 15 | 107 | 7 |
| AD-1223012.1 | 71 | 10 | 92 | 14 | 96 | 11 | 99 | 6 |
| AD-1223013.1 | 99 | 9 | 114 | 19 | 79 | 23 | 100 | 5 |
| AD-1223014.1 | 77 | 4 | 95 | 10 | 87 | 4 | 101 | 5 |
| AD-1223015.1 | 69 | 13 | 86 | 8 | 82 | 14 | 97 | 12 |
| AD-1223016.1 | 52 | 1 | 76 | 7 | 95 | 18 | 101 | 11 |
| AD-1223017.1 | 45 | 6 | 55 | 1 | 67 | 7 | 84 | 8 |
| AD-1223018.1 | 39 | 9 | 60 | 2 | 80 | 9 | 90 | 4 |
| AD-1223019.1 | 62 | 6 | 59 | 11 | 87 | 6 | 86 | 4 |
| AD-1223020.1 | 60 | 13 | 65 | 2 | 68 | 28 | 82 | 13 |
| AD-1223021.1 | 76 | 6 | 73 | 19 | 70 | 10 | 85 | 8 |
| AD-1223022.1 | 60 | 10 | 64 | 3 | 70 | 3 | 77 | 5 |
| AD-1223023.1 | 56 | 4 | 62 | 3 | 90 | 24 | 73 | 7 |
| AD-1223024.1 | 52 | 3 | 60 | 3 | 63 | 5 | 71 | 21 |
| AD-1223025.1 | 53 | 10 | 64 | 3 | 76 | 3 | 86 | 10 |
| AD-1223026.1 | 63 | 5 | 53 | 7 | 62 | 15 | 85 | 10 |
| AD-1223027.1 | 72 | 14 | 79 | 14 | 80 | 10 | 83 | 4 |
| AD-1223028.1 | 64 | 7 | 68 | 7 | 74 | 3 | 81 | 11 |
| AD-1223029.1 | 78 | 4 | 75 | 17 | 68 | 11 | 82 | 6 |
| AD-1223030.1 | 41 | 8 | 49 | 6 | 68 | 4 | 69 | 7 |
| AD-1223031.1 | 26 | 1 | 34 | 1 | 37 | 6 | 48 | 4 |
| AD-1223032.1 | 35 | 1 | 49 | 5 | 56 | 8 | 73 | 1 |
| AD-1223033.1 | 34 | 6 | 43 | 3 | 59 | 13 | 71 | 3 |
| AD-1223034.1 | 49 | 5 | 50 | 1 | 68 | 2 | 82 | 6 |
| AD-1223035.1 | 36 | 3 | 42 | 8 | 55 | 1 | 74 | 8 |
| AD-1223036.1 | 32 | 5 | 39 | 11 | 49 | 2 | 75 | 5 |
| AD-1223037.1 | 28 | 8 | 29 | 4 | 47 | 11 | 68 | 6 |
| AD-1223038.1 | 23 | 4 | 38 | 6 | 49 | 5 | 69 | 5 |
| AD-1223039.1 | 26 | 9 | 40 | 1 | 41 | 4 | 61 | 11 |
| AD-1223040.1 | 29 | 5 | 37 | 6 | 37 | 4 | 54 | 3 |
| AD-1223041.1 | 31 | 1 | 35 | 2 | 41 | 1 | 53 | 6 |
| AD-1223042.1 | 29 | 4 | 32 | 5 | 42 | 12 | 64 | 10 |
| AD-1223043.1 | 27 | 3 | 40 | 7 | 47 | 6 | 58 | 4 |
| AD-1223044.1 | 29 | 2 | 40 | 3 | 39 | 1 | 55 | 1 |
| AD-1223045.1 | 31 | 2 | 44 | 3 | 42 | 8 | 62 | 5 |
| AD-1223046.1 | 39 | 2 | 42 | 3 | 69 | 4 | 92 | 15 |
| AD-1223047.1 | 35 | 8 | 38 | 5 | 69 | 5 | 80 | 7 |
| AD-1223048.1 | 30 | 2 | 40 | 4 | 71 | 4 | 92 | 21 |
| AD-1223049.1 | 38 | 1 | 45 | 11 | 65 | 2 | 86 | 16 |
| AD-1223050.1 | 36 | 5 | 51 | 6 | 67 | 3 | 82 | 17 |
| AD-1223051.1 | 47 | 7 | 56 | 7 | 68 | 3 | 66 | 10 |

TABLE 9B-continued

VEGF-A endogenous in vitro multi-dose screen following free uptake of one set of exemplary human VEGF-A siRNAs

| DuplexID | 500 nM | StDev | 100 nM | StDev | 10 nM | StDev | 1 nM | StDev |
|---|---|---|---|---|---|---|---|---|
| AD-1223052.1 | 39 | 12 | 47 | 2 | 68 | 1 | 66 | 7 |
| AD-1223053.1 | 42 | 4 | 58 | 15 | 63 | 1 | 56 | 6 |
| AD-1223054.1 | 43 | 9 | 53 | 5 | 87 | 2 | 88 | 1 |
| AD-1223055.1 | 38 | 10 | 52 | 10 | 84 | 6 | 93 | 2 |
| AD-1223056.1 | 49 | 17 | 51 | 9 | 80 | 6 | 125 | 26 |
| AD-1223057.1 | 50 | 3 | 45 | 11 | 81 | 3 | 95 | 12 |
| AD-1223058.1 | 29 | 6 | 38 | 8 | 77 | 4 | 92 | 27 |
| AD-1223059.1 | 28 | 2 | 37 | 6 | 77 | 7 | 67 | 15 |
| AD-1223060.1 | 33 | 1 | 51 | 10 | 68 | 3 | 58 | 1 |
| AD-1223061.1 | 31 | 1 | 44 | 4 | 67 | 3 | 68 | 13 |
| AD-1223062.1 | 57 | 10 | 59 | 4 | 103 | 8 | 80 | 13 |
| AD-1223063.1 | 66 | 5 | 57 | 5 | 102 | 6 | 98 | 24 |
| AD-1223064.1 | 65 | 16 | 75 | 11 | 109 | 14 | 91 | 1 |
| AD-1223065.1 | 50 | 2 | 67 | 22 | 103 | 2 | 91 | 19 |
| AD-1223066.1 | 30 | 5 | 37 | 4 | 84 | 6 | 76 | 1 |
| AD-1223067.1 | 40 | 3 | 54 | 12 | 81 | 9 | 71 | 11 |
| AD-1223068.1 | 36 | 1 | 37 | 5 | 70 | 6 | 61 | 6 |
| AD-1223069.1 | 67 | 27 | 73 | 11 | 99 | 17 | 103 | 21 |
| AD-1223070.1 | 65 | 19 | 58 | 3 | 105 | 3 | 116 | 24 |
| AD-1223071.1 | 40 | 5 | 58 | 14 | 96 | 8 | 90 | 2 |
| AD-1223072.1 | 65 | 14 | 85 | 24 | 115 | 15 | 74 | 15 |
| AD-1223073.1 | 39 | 1 | 59 | 9 | 110 | 14 | 79 | 17 |
| AD-1223074.1 | 42 | 6 | 54 | 5 | 87 | 4 | 63 | 5 |
| AD-1223075.1 | 47 | 10 | 38 | 2 | 78 | 3 | 54 | 2 |
| AD-1223076.1 | 78 | 20 | 70 | 16 | 68 | 14 | 99 | 22 |
| AD-1223077.1 | 70 | 14 | 76 | 11 | 103 | 19 | 90 | 5 |
| AD-1223078.1 | 105 | 6 | 113 | 26 | 106 | 9 | 122 | 9 |
| AD-1223079.1 | 64 | 11 | 76 | 4 | 107 | 7 | 98 | 16 |
| AD-1223080.1 | 79 | 10 | 67 | 19 | 87 | 4 | 89 | 19 |
| AD-1223081.1 | 67 | 21 | 80 | 17 | 99 | 5 | 82 | 16 |
| AD-1223082.1 | 37 | 4 | 45 | 16 | 85 | 13 | 68 | 15 |
| AD-1223083.1 | 44 | 16 | 50 | 7 | 78 | 6 | 64 | 12 |
| AD-1223084.1 | 59 | 12 | 57 | 1 | 96 | 17 | 95 | 3 |
| AD-1223085.1 | 86 | 28 | 79 | 8 | 100 | 3 | 101 | 15 |
| AD-1223086.1 | 67 | 8 | 58 | 6 | 93 | 9 | 123 | 3 |
| AD-1223087.1 | 82 | 21 | 101 | 5 | 95 | 13 | 97 | 8 |
| AD-1223088.1 | 76 | 25 | 92 | 2 | 127 | 20 | 100 | 21 |
| AD-1223089.1 | 78 | 17 | 68 | 17 | 93 | 2 | 83 | 17 |
| AD-1223090.1 | 38 | 3 | 55 | 13 | 84 | 10 | 63 | 16 |
| AD-1223091.1 | 78 | 15 | 60 | 9 | 97 | 23 | 113 | 3 |
| AD-1223092.1 | 66 | 3 | 69 | 16 | 112 | 13 | 79 | 18 |
| AD-1223093.1 | 65 | 1 | 60 | 5 | 119 | 23 | 95 | 15 |
| AD-1223094.1 | 57 | 10 | 61 | 11 | 92 | 7 | 87 | 11 |
| AD-1223095.1 | 67 | 2 | 60 | 9 | 88 | 11 | 97 | 4 |
| AD-1223096.1 | 52 | 20 | 57 | 5 | 100 | 23 | 66 | 13 |
| AD-1223097.1 | 40 | 2 | 64 | 8 | 80 | 7 | 57 | 4 |
| AD-1223098.1 | 41 | 13 | 47 | 6 | 72 | 2 | 50 | 6 |
| AD-1223099.1 | 60 | 18 | 66 | 5 | 76 | 17 | 103 | 20 |
| AD-1223100.1 | 46 | 15 | 54 | 10 | 77 | 6 | 81 | 4 |
| AD-1223101.1 | 76 | 8 | 67 | 16 | 110 | 15 | 91 | 17 |
| AD-1223102.1 | 45 | 6 | 69 | 13 | 96 | 15 | 90 | 6 |
| AD-1223103.1 | 70 | 17 | 71 | 2 | 107 | 18 | 65 | 1 |
| AD-1223104.1 | 57 | 22 | 52 | 8 | 73 | 9 | 55 | 4 |
| AD-1223105.1 | 48 | 15 | 69 | 16 | 84 | 25 | 64 | 16 |
| AD-1223106.1 | 61 | 8 | 59 | 13 | 95 | 6 | 53 | 4 |
| AD-1223107.1 | 71 | 2 | 60 | 20 | 77 | 9 | 89 | 11 |
| AD-1223108.1 | 78 | 3 | 62 | 5 | 85 | 13 | 78 | 5 |
| AD-1223109.1 | 74 | 18 | 63 | 18 | 85 | 0 | 84 | 19 |
| AD-1223110.1 | 64 | 4 | 78 | 9 | 104 | 29 | 73 | 10 |
| AD-1223111.1 | 90 | 8 | 74 | 19 | 83 | 21 | 72 | 15 |
| AD-1223112.1 | 71 | 10 | 87 | 14 | 78 | 14 | 66 | 8 |
| AD-1223113.1 | 62 | 12 | 80 | 1 | 83 | 20 | 60 | 5 |
| AD-1223114.1 | 71 | 18 | 62 | 9 | 68 | 1 | 62 | 10 |
| AD-1223115.1 | 111 | 5 | 80 | 15 | 82 | 7 | 82 | 3 |
| AD-1223116.1 | 80 | 22 | 80 | 10 | 73 | 7 | 92 | 2 |
| AD-1223117.1 | 84 | 23 | 98 | 2 | 92 | 23 | 73 | 17 |
| AD-1223118.1 | 71 | 25 | 67 | 17 | 82 | 26 | 63 | 5 |
| AD-1223119.1 | 66 | 15 | 91 | 33 | 82 | 31 | 87 | 21 |
| AD-1223120.1 | 61 | 6 | 64 | 13 | 88 | 7 | 59 | 4 |
| AD-1223121.1 | 66 | 9 | 49 | 11 | 66 | 5 | 59 | 6 |
| AD-1223122.1 | 90 | 11 | 68 | 20 | 62 | 10 | 74 | 15 |
| AD-1223123.1 | 61 | 22 | 52 | 20 | 53 | 0 | 63 | 4 |
| AD-1223124.1 | 89 | 12 | 72 | 16 | 65 | 5 | 83 | 11 |
| AD-1223125.1 | 77 | 22 | 72 | 18 | 65 | 7 | 73 | 8 |
| AD-1223126.1 | 96 | 18 | 80 | 20 | 77 | 32 | 74 | 13 |

TABLE 9B-continued

VEGF-A endogenous in vitro multi-dose screen following free uptake of one set of exemplary human VEGF-A siRNAs

| DuplexID | 500 nM | StDev | 100 nM | StDev | 10 nM | StDev | 1 nM | StDev |
|---|---|---|---|---|---|---|---|---|
| AD-1223127.1 | 54 | 11 | 60 | 9 | 53 | 9 | 64 | 12 |
| AD-1223128.1 | 58 | 16 | 45 | 1 | 67 | 1 | 65 | 8 |
| AD-1223129.1 | 45 | 7 | 39 | 6 | 56 | 5 | 60 | 1 |
| AD-1223130.1 | 37 | 2 | 50 | 3 | 51 | 5 | 74 | 7 |
| AD-1223131.1 | 57 | 17 | 45 | 13 | 66 | 5 | 70 | 2 |
| AD-1223132.1 | 72 | 16 | 53 | 5 | 71 | 18 | 92 | 7 |
| AD-1223133.1 | 42 | 3 | 57 | 7 | 54 | 2 | 61 | 9 |
| AD-1223134.1 | 49 | 11 | 46 | 1 | 59 | 1 | 84 | 22 |
| AD-1223135.1 | 46 | 3 | 50 | 11 | 57 | 5 | 69 | 1 |
| AD-1223136.1 | 101 | 19 | 100 | 15 | 88 | 26 | 159 | 78 |
| AD-1223137.1 | 88 | 14 | 92 | 13 | 98 | 19 | 91 | 23 |
| AD-1223138.1 | 75 | 9 | 67 | 4 | 71 | 17 | 86 | 26 |
| AD-1223139.1 | 89 | 19 | 63 | 6 | 97 | 31 | 82 | 10 |
| AD-1223140.1 | 90 | 28 | 71 | 8 | 59 | 10 | 76 | 12 |
| AD-1223141.1 | 83 | 3 | 64 | 9 | 62 | 6 | 75 | 14 |
| AD-1223142.1 | 102 | 5 | 61 | 1 | 74 | 19 | 73 | 2 |
| AD-1223143.1 | 96 | 31 | 54 | 1 | 57 | 15 | 88 | 15 |
| AD-1223144.1 | 91 | 16 | 82 | 10 | 112 | 9 | 129 | 35 |
| AD-1223145.1 | 86 | 15 | 74 | 10 | 86 | 5 | 125 | 21 |
| AD-1223146.1 | 81 | 10 | 85 | 3 | 94 | 1 | 143 | 21 |
| AD-1223147.1 | 99 | 15 | 80 | 17 | 86 | 10 | 109 | 24 |
| AD-1223148.1 | 93 | 22 | 82 | 12 | 91 | 17 | 115 | 18 |
| AD-1223149.1 | 88 | 6 | 74 | 4 | 88 | 15 | 110 | 11 |
| AD-1223150.1 | 79 | 6 | 66 | 1 | 71 | 5 | 103 | 17 |
| AD-1223151.1 | 98 | 20 | 64 | 9 | 61 | 17 | 108 | 20 |
| AD-1223152.1 | 121 | 28 | 92 | 14 | 78 | 5 | 102 | 17 |
| AD-1223153.1 | 80 | 15 | 93 | 9 | 105 | 7 | 122 | 23 |
| AD-1223154.1 | 73 | 14 | 85 | 5 | 87 | 13 | 109 | 10 |
| AD-1223155.1 | 87 | 2 | 68 | 3 | 92 | 12 | 108 | 17 |
| AD-1223156.1 | 74 | 19 | 72 | 2 | 73 | 8 | 102 | 12 |
| AD-1223157.1 | 83 | 21 | 76 | 5 | 78 | 12 | 101 | 20 |
| AD-1223158.1 | 78 | 22 | 64 | 12 | 75 | 2 | 97 | 24 |
| AD-1223159.1 | 102 | 36 | 75 | 9 | 115 | 22 | 104 | 16 |
| AD-1223160.1 | 116 | 20 | 122 | 15 | 105 | 13 | 154 | 18 |
| AD-1223161.1 | 80 | 14 | 96 | 7 | 114 | 14 | 99 | 6 |
| AD-1223162.1 | 60 | 5 | 76 | 7 | 97 | 18 | 111 | 24 |
| AD-1223163.1 | 85 | 18 | 79 | 10 | 83 | 15 | 118 | 22 |
| AD-1223164.1 | 75 | 1 | 95 | 21 | 78 | 8 | 113 | 7 |
| AD-1223165.1 | 73 | 7 | 68 | 8 | 66 | 2 | 111 | 28 |
| AD-1223166.1 | 106 | 19 | 92 | 4 | 98 | 37 | 100 | 11 |
| AD-1223167.1 | 111 | 12 | 116 | 21 | 121 | 5 | 124 | 11 |
| AD-1223168.1 | 102 | 20 | 93 | 2 | 124 | 25 | 145 | 4 |
| AD-1223169.1 | 93 | 23 | 89 | 18 | 132 | 17 | 133 | 5 |
| AD-1223170.1 | 85 | 14 | 79 | 25 | 111 | 11 | 119 | 26 |
| AD-1223171.1 | 82 | 19 | 77 | 9 | 89 | 12 | 121 | 30 |
| AD-1223172.1 | 90 | 3 | 76 | 5 | 92 | 7 | 89 | 6 |
| AD-1223173.1 | 74 | 14 | 79 | 15 | 85 | 18 | 119 | 36 |
| AD-1223174.1 | 135 | 52 | 80 | 8 | 90 | 3 | 95 | 15 |
| AD-1223175.1 | 86 | 20 | 96 | 8 | 87 | 4 | 116 | 5 |
| AD-1223176.1 | 88 | 17 | 104 | 12 | 99 | 15 | 123 | 3 |
| AD-1223177.1 | 81 | 14 | 78 | 6 | 90 | 8 | 109 | 23 |
| AD-1223178.1 | 106 | 7 | 80 | 14 | 88 | 2 | 118 | 15 |
| AD-1223179.1 | 83 | 14 | 71 | 10 | 93 | 8 | 95 | 18 |
| AD-1223180.1 | 61 | 19 | 67 | 9 | 79 | 9 | 127 | 4 |
| AD-1223181.1 | 105 | 31 | 80 | 5 | 99 | 12 | 106 | 12 |
| AD-1223182.1 | 69 | 2 | 81 | 12 | 88 | 5 | 105 | 20 |
| AD-1223183.1 | 108 | 38 | 85 | 6 | 106 | 9 | 123 | 17 |
| AD-1223184.1 | 45 | 6 | 61 | 4 | 75 | 8 | 82 | 12 |
| AD-1223185.1 | 59 | 4 | 76 | 15 | 75 | 3 | 107 | 20 |
| AD-1223186.1 | 66 | 12 | 62 | 10 | 88 | 11 | 89 | 7 |
| AD-1223187.1 | 63 | 10 | 58 | 10 | 72 | 7 | 99 | 20 |
| AD-1223188.1 | 51 | 12 | 47 | 8 | 71 | 9 | 90 | 19 |
| AD-1223189.1 | 73 | 15 | 56 | 3 | 75 | 11 | 85 | 2 |
| AD-1223190.1 | 57 | 13 | 61 | 5 | 80 | 13 | 89 | 18 |
| AD-1223191.1 | 55 | 14 | 68 | 9 | 71 | 1 | 100 | 8 |
| AD-1223192.1 | 39 | 3 | 61 | 9 | 73 | 4 | 92 | 16 |
| AD-1223193.1 | 41 | 9 | 51 | 2 | 72 | 9 | 69 | 4 |
| AD-1223194.1 | 34 | 2 | 44 | 5 | 61 | 9 | 79 | 18 |
| AD-1223195.1 | 52 | 17 | 38 | 5 | 65 | 11 | 89 | 12 |
| AD-1223196.1 | 36 | 4 | 39 | 4 | 89 | 22 | 85 | 20 |
| AD-1223197.1 | 66 | 13 | 40 | 6 | 62 | 16 | 70 | 10 |
| AD-1223198.1 | 56 | 8 | 66 | 5 | 78 | 23 | 95 | 14 |
| AD-1223199.1 | 56 | 17 | 61 | 6 | 75 | 5 | 113 | 30 |
| AD-1223200.1 | 51 | 14 | 51 | 9 | 68 | 14 | 102 | 17 |
| AD-1223201.1 | 60 | 15 | 53 | 3 | 59 | 6 | 81 | 3 |

TABLE 9B-continued

VEGF-A endogenous in vitro multi-dose screen following free uptake of one set of exemplary human VEGF-A siRNAs

| DuplexID | 500 nM | StDev | 100 nM | StDev | 10 nM | StDev | 1 nM | StDev |
|---|---|---|---|---|---|---|---|---|
| AD-1223202.1 | 36 | 10 | 46 | 3 | 57 | 9 | 95 | 1 |
| AD-1223203.1 | 43 | 13 | 34 | 1 | 66 | 13 | 82 | 19 |
| AD-1223204.1 | 63 | 16 | 49 | 3 | 60 | 5 | 57 | 3 |
| AD-1223205.1 | 51 | 14 | 57 | 5 | 75 | 3 | 75 | 12 |
| AD-1223206.1 | 30 | 4 | 49 | 10 | 69 | 14 | 67 | 6 |
| AD-1223207.1 | 67 | 11 | 67 | 6 | 67 | 7 | 77 | 11 |
| AD-1223208.1 | 64 | 11 | 61 | 8 | 68 | 4 | 84 | 24 |
| AD-1223209.1 | 56 | 12 | 62 | 7 | 73 | 11 | 86 | 16 |
| AD-1223210.1 | 58 | 33 | 40 | 2 | 69 | 8 | 93 | 2 |
| AD-1223211.1 | 39 | 0 | 48 | 4 | 52 | 15 | 57 | 5 |
| AD-1223212.1 | 65 | 5 | 57 | 2 | 53 | 2 | 95 | 20 |
| AD-1223213.1 | 55 | 11 | 57 | 3 | 69 | 5 | 78 | 10 |
| AD-1223214.1 | 28 | 2 | 46 | 1 | 53 | 8 | 70 | 5 |
| AD-1223215.1 | 37 | 2 | 52 | 1 | 61 | 12 | 80 | 11 |
| AD-1223216.1 | 42 | 14 | 47 | 3 | 67 | 31 | 72 | 6 |
| AD-1223217.1 | 43 | 7 | 52 | 3 | 66 | 5 | 86 | 2 |
| AD-1223218.1 | 64 | 26 | 45 | 6 | 59 | 13 | 86 | 11 |
| AD-1223219.1 | 70 | 10 | 55 | 7 | 56 | 8 | 58 | 3 |
| AD-1223220.1 | 54 | 15 | 64 | 3 | 42 | 4 | 57 | 2 |
| AD-1223221.1 | 51 | 15 | 55 | 6 | 45 | 8 | 62 | 8 |
| AD-1223222.1 | 70 | 5 | 66 | 5 | 58 | 6 | 86 | 20 |
| AD-1223223.1 | 37 | 5 | 54 | 4 | 59 | 14 | 61 | 15 |
| AD-1223224.1 | 55 | 4 | 40 | 1 | 51 | 4 | 61 | 3 |
| AD-1223225.1 | 49 | 17 | 41 | 6 | 61 | 11 | 68 | 1 |
| AD-1223226.1 | 57 | 3 | 46 | 12 | 71 | 4 | 83 | 19 |
| AD-1223227.1 | 73 | 7 | 55 | 1 | 80 | 7 | 92 | 14 |
| AD-1223228.1 | 51 | 5 | 41 | 3 | 72 | 4 | 89 | 6 |
| AD-1223229.1 | 63 | 7 | 54 | 11 | 86 | 5 | 99 | 13 |
| AD-1223230.1 | 52 | 7 | 46 | 8 | 81 | 8 | 81 | 12 |
| AD-1223231.1 | 61 | 4 | 52 | 1 | 78 | 9 | 88 | 11 |
| AD-1223232.1 | 76 | 6 | 64 | 7 | 75 | 8 | 80 | 13 |
| AD-1223233.1 | 70 | 8 | 53 | 6 | 77 | 5 | 66 | 12 |
| AD-1223234.1 | 68 | 11 | 56 | 14 | 81 | 5 | 94 | 14 |
| AD-1223235.1 | 58 | 4 | 41 | 2 | 94 | 2 | 96 | 7 |
| AD-1223236.1 | 72 | 4 | 62 | 19 | 101 | 10 | 99 | 6 |
| AD-1223237.1 | 78 | 10 | 63 | 3 | 109 | 5 | 103 | 20 |
| AD-1223238.1 | 67 | 16 | 65 | 22 | 102 | 14 | 100 | 15 |
| AD-1223239.1 | 58 | 2 | 57 | 3 | 90 | 8 | 89 | 21 |
| AD-1223240.1 | 57 | 1 | 53 | 8 | 87 | 7 | 79 | 12 |
| AD-1223241.1 | 62 | 9 | 50 | 10 | 73 | 11 | 70 | 18 |
| AD-1223242.1 | 54 | 9 | 55 | 11 | 70 | 8 | 87 | 4 |
| AD-1223243.1 | 62 | 11 | 48 | 4 | 77 | 6 | 114 | 6 |
| AD-1223244.1 | 57 | 5 | 54 | 9 | 94 | 9 | 105 | 18 |
| AD-1223245.1 | 75 | 8 | 78 | 2 | 111 | 28 | 116 | 9 |
| AD-1223246.1 | 51 | 4 | 49 | 3 | 85 | 8 | 92 | 6 |
| AD-1223247.1 | 61 | 7 | 53 | 11 | 87 | 10 | 81 | 6 |
| AD-1223248.1 | 60 | 2 | 54 | 11 | 75 | 1 | 72 | 11 |
| AD-1223249.1 | 65 | 7 | 71 | 5 | 85 | 12 | 111 | 8 |
| AD-1223250.1 | 85 | 15 | 89 | 3 | 118 | 14 | 131 | 1 |
| AD-1223251.1 | 74 | 6 | 88 | 5 | 108 | 8 | 102 | 2 |
| AD-1223252.1 | 55 | 3 | 78 | 19 | 107 | 19 | 95 | 11 |
| AD-1223253.1 | 48 | 7 | 69 | 6 | 94 | 9 | 90 | 13 |
| AD-1223254.1 | 58 | 11 | 59 | 21 | 96 | 15 | 83 | 5 |
| AD-1223255.1 | 48 | 5 | 58 | 11 | 79 | 5 | 68 | 2 |
| AD-1223256.1 | 51 | 9 | 53 | 7 | 75 | 4 | 99 | 11 |
| AD-1223257.1 | 44 | 2 | 43 | 6 | 98 | 10 | 120 | 15 |
| AD-1223258.1 | 68 | 8 | 67 | 6 | 107 | 12 | 111 | 6 |
| AD-1223259.1 | 96 | 7 | 103 | 8 | 111 | 15 | 106 | 1 |
| AD-1223260.1 | 82 | 2 | 80 | 7 | 114 | 15 | 112 | 11 |
| AD-1223261.1 | 62 | 1 | 64 | 3 | 99 | 20 | 95 | 1 |
| AD-1223262.1 | 48 | 10 | 48 | 9 | 86 | 8 | 90 | 6 |
| AD-1223263.1 | 51 | 5 | 49 | 6 | 71 | 3 | 71 | 5 |
| AD-1223264.1 | 51 | 2 | 56 | 13 | 75 | 7 | 79 | 3 |
| AD-1223265.1 | 48 | 3 | 47 | 1 | 82 | 1 | 94 | 12 |
| AD-1223266.1 | 42 | 6 | 49 | 5 | 84 | 1 | 105 | 9 |
| AD-1223267.1 | 76 | 2 | 101 | 20 | 105 | 7 | 108 | 11 |
| AD-1223268.1 | 63 | 12 | 83 | 28 | 96 | 13 | 86 | 17 |
| AD-1223269.1 | 43 | 4 | 51 | 17 | 93 | 0 | 84 | 10 |
| AD-1223270.1 | 63 | 3 | 56 | 7 | 96 | 6 | 95 | 1 |
| AD-1223271.1 | 58 | 1 | 63 | 18 | 71 | 2 | 93 | 11 |

TABLE 9B-continued

| VEGF-A endogenous in vitro multi-dose screen following free uptake of one set of exemplary human VEGF-A siRNAs | | | | | | | | |
|---|---|---|---|---|---|---|---|---|
| DuplexID | 500 nM | StDev | 100 nM | StDev | 10 nM | StDev | 1 nM | StDev |
| AD-1223272.1 | 55 | 7 | 56 | 11 | 82 | 1 | 106 | 7 |
| AD-1223273.1 | 66 | 10 | 63 | 18 | 106 | 9 | 120 | 15 |
| AD-1223274.1 | 67 | 6 | 64 | 13 | 97 | 13 | 98 | 12 |
| AD-1223275.1 | 67 | 8 | 88 | 17 | 103 | 9 | 79 | 8 |
| AD-1223276.1 | 75 | 10 | 64 | 13 | 94 | 13 | 84 | 3 |
| AD-1223277.1 | 73 | 5 | 62 | 6 | 88 | 15 | 82 | 1 |
| AD-1223278.1 | 60 | 3 | 61 | 7 | 83 | 10 | 81 | 5 |
| AD-1223279.1 | 65 | 3 | 64 | 12 | 88 | 12 | 93 | 13 |
| AD-1223280.1 | 67 | 2 | 67 | 9 | 89 | 4 | 119 | 9 |
| AD-1223281.1 | 68 | 8 | 62 | 16 | 95 | 10 | 96 | 2 |
| AD-1223282.1 | 57 | 7 | 73 | 2 | 87 | 8 | 95 | 3 |
| AD-1223283.1 | 50 | 3 | 75 | 3 | 75 | 2 | 80 | 1 |
| AD-1223284.1 | 51 | 7 | 61 | 26 | 84 | 9 | 80 | 2 |
| AD-1223285.1 | 70 | 13 | 70 | 10 | 89 | 15 | 87 | 8 |
| AD-1223286.1 | 43 | 1 | 48 | 8 | 73 | 18 | 77 | 8 |
| AD-1223287.1 | 50 | 4 | 46 | 16 | 65 | 4 | 76 | 0 |
| AD-1223288.1 | 56 | 9 | 55 | 20 | 75 | 10 | 78 | 3 |
| AD-1223289.1 | 72 | 19 | 57 | 10 | 87 | 3 | 91 | 10 |
| AD-1223290.1 | 67 | 2 | 73 | 5 | 88 | 13 | 89 | 6 |
| AD-1223291.1 | 74 | 11 | 69 | 15 | 81 | 1 | 70 | 8 |
| AD-1223292.1 | 61 | 2 | 58 | 5 | 81 | 2 | 78 | 1 |
| AD-1223293.1 | 63 | 9 | 60 | 6 | 82 | 4 | 74 | 6 |
| AD-1223294.1 | 54 | 2 | 56 | 10 | 53 | 2 | 68 | 1 |
| AD-1223295.1 | 80 | 14 | 90 | 3 | 75 | 10 | 76 | 13 |
| AD-1223296.1 | 92 | 20 | 109 | 8 | 87 | 10 | 95 | 11 |
| AD-1223297.1 | 75 | 9 | 89 | 2 | 80 | 5 | 96 | 4 |
| AD-1223298.1 | 75 | 6 | 79 | 10 | 86 | 11 | 94 | 2 |
| AD-1223299.1 | 77 | 8 | 79 | 6 | 89 | 6 | 82 | 1 |
| AD-1223300.1 | 78 | 15 | 72 | 5 | 76 | 5 | 71 | 8 |
| AD-1223301.1 | 64 | 4 | 67 | 9 | 57 | 2 | 60 | 8 |
| AD-1223302.1 | 66 | 5 | 79 | 17 | 66 | 4 | 71 | 9 |
| AD-1223303.1 | 78 | 9 | 86 | 14 | 68 | 1 | 74 | 9 |
| AD-1223304.1 | 64 | 2 | 76 | 10 | 72 | 7 | 72 | 5 |
| AD-1223305.1 | 59 | 4 | 72 | 11 | 66 | 3 | 78 | 13 |
| AD-1223306.1 | 58 | 1 | 51 | 33 | 77 | 23 | 81 | 13 |
| AD-1223307.1 | 61 | 9 | 78 | 15 | 63 | 4 | 70 | 5 |
| AD-1223308.1 | 52 | 7 | 52 | 10 | 63 | 5 | 58 | 6 |
| AD-1223309.1 | 60 | 1 | 39 | 4 | 59 | 4 | 60 | 5 |
| AD-1223310.1 | 52 | 5 | 40 | 7 | 60 | 2 | 55 | 4 |
| AD-1223311.1 | 62 | 7 | 59 | 13 | 62 | 2 | 54 | 5 |
| AD-1223312.1 | 49 | 8 | 44 | 8 | 50 | 5 | 56 | 8 |
| AD-1223313.1 | 43 | 5 | 44 | 9 | 51 | 3 | 50 | 0 |
| AD-1223314.1 | 45 | 8 | 39 | 4 | 53 | 5 | 49 | 6 |
| AD-1223315.1 | 53 | 4 | 46 | 7 | 56 | 5 | 50 | 6 |

The results of the multi-dose screen in primary human hepatocytes transfected with an additional set of exemplary human VEGF-A siRNAs is shown in Table 11 (correspond to modified siRNAs in Table 10A). The multi-dose experiments were performed at 50 nM, 10 nM, 1 nM, and 0.1 nM final duplex concentrations and the data are expressed as percent message remaining relative to non-targeting control.

Of the exemplary siRNA duplexes evaluated in Table 11, 6 achieved a knockdown of VEGF-A of ≥70%, 34 achieved a knockdown of VEGF-A of ≥60%, 49 achieved a knockdown of VEGF-A of ≥50%, 62 achieved a knockdown of VEGF-A of ≥30%, and 75 achieved a knockdown of VEGF-A of ≥20% when administered at the 50 nM concentration.

Of the exemplary siRNA duplexes evaluated in Table 11, 2 achieved a knockdown of VEGF-A of ≥70%, 18 achieved a knockdown of VEGF-A of ≥60%, 35 achieved a knockdown of VEGF-A of ≥50%, 66 achieved a knockdown of VEGF-A of ≥30%, and 77 achieved a knockdown of VEGF-A of ≥20% when administered at the 10 nM concentration.

Of the exemplary siRNA duplexes evaluated in Table 11, 13 achieved a knockdown of VEGF-A of ≥50%, 33 achieved a knockdown of VEGF-A of ≥40%, 49 achieved a knockdown of VEGF-A of ≥30%, 62 achieved a knockdown of VEGF-A of ≥20%, and 74 achieved a knockdown of VEGF-A of ≥10% when administered at the 1 nM concentration.

Of the exemplary siRNA duplexes evaluated in Table 11, 2 achieved a knockdown of VEGF-A of ≥40%, 7 achieved a knockdown of VEGF-A of ≥30%, 25 achieved a knockdown of VEGF-A of ≥20%, 46 achieved a knockdown of VEGF-A of ≥10%, and 55 achieved a knockdown of VEGF-A of ≥5% when administered at the 0.1 nM concentration.

TABLE 11

VEGF-A endogenous in vitro multi-dose screen following cellular transfection with additional set of exemplary human VEGF-A siRNAs

| Duplex | 50 nM dose Avg | 50 nM dose SD | 10 nM dose Avg | 10 nM dose SD | 1 nM dose Avg | 1 nM dose SD | 0.1 nM dose Avg | 0.1 nM dose SD |
|---|---|---|---|---|---|---|---|---|
| AD-1353514.1 | 73.2 | 14.7 | 47.83 | 6.33 | 89.52 | 8.82 | 108.56 | 17.50 |
| AD-1353484.1 | 60.9 | 2.1 | 30.99 | 3.11 | 46.98 | 8.32 | 74.34 | 10.43 |
| AD-1353454.1 | 32.1 | 2.1 | 31.33 | 5.04 | 48.05 | 7.92 | 52.74 | 3.79 |
| AD-1353468.1 | 36.5 | 10.1 | 37.70 | 11.20 | 54.44 | 8.95 | 76.93 | 5.45 |
| AD-1353498.1 | 71.4 | 8.9 | 70.68 | 17.79 | 91.31 | 15.16 | 119.43 | 2.90 |
| AD-1353438.1 | 30.4 | 5.0 | 36.17 | 11.97 | 49.92 | 9.56 | 68.61 | 10.47 |
| AD-1353515.1 | 85.4 | 4.7 | 59.45 | 15.56 | 86.89 | 15.76 | 119.70 | 10.55 |
| AD-1353485.1 | 61.2 | 3.6 | 67.37 | 28.56 | 73.00 | 19.46 | 101.36 | 12.30 |
| AD-1353455.1 | 37.7 | 5.8 | 39.73 | 4.39 | 57.46 | 11.43 | 75.26 | 9.60 |
| AD-1353513.1 | 72.4 | 19.2 | 70.36 | 7.66 | 65.81 | 2.00 | 99.31 | 4.26 |
| AD-1353483.1 | 45.4 | 7.9 | 59.48 | 13.52 | 63.00 | 1.14 | 88.59 | 7.06 |
| AD-1353453.1 | 49.4 | 3.1 | 52.47 | 11.81 | 73.02 | 14.48 | 87.42 | 1.86 |
| AD-1353502.1 | 111.8 | 3.9 | 122.89 | 9.45 | 108.63 | 2.65 | 101.24 | 12.32 |
| AD-1353472.1 | 77.7 | 1.1 | 77.95 | 21.21 | 82.89 | 10.59 | 110.13 | 1.33 |
| AD-1353442.1 | 43.1 | 5.9 | 58.75 | 26.58 | 53.92 | 6.62 | 86.50 | 13.94 |
| AD-1353499.1 | 52.6 | 8.5 | 50.86 | 1.41 | 60.86 | 4.25 | 68.29 | 32.87 |
| AD-1353469.1 | 34.2 | 4.9 | 26.91 | 8.25 | 52.31 | 12.97 | 68.94 | 3.00 |
| AD-1353439.1 | 40.5 | 7.0 | 33.92 | 5.01 | 47.72 | 5.18 | 59.98 | 0.64 |
| AD-1353516.1 | 73.4 | 2.3 | 91.54 | 6.70 | 96.22 | 13.84 | 109.69 | 16.01 |
| AD-1353486.1 | 55.2 | 10.8 | 69.54 | 22.45 | 66.89 | 15.26 | 85.60 | 12.44 |
| AD-1353456.1 | 36.7 | 2.3 | 40.99 | 2.33 | 47.06 | 0.75 | 77.80 | 12.27 |
| AD-1353509.1 | 78.2 | 15.5 | 65.05 | 19.24 | 79.91 | 15.99 | 92.15 | 6.76 |
| AD-1353479.1 | 34.1 | 1.7 | 59.07 | 11.65 | 61.37 | 12.56 | 81.86 | 11.12 |
| AD-1353449.1 | 37.2 | 3.1 | 43.76 | 2.00 | 64.46 | 14.54 | 94.21 | 15.51 |
| AD-1353503.1 | 107.2 | 12.2 | 124.19 | 25.48 | 129.99 | 12.55 | 103.32 | 5.51 |
| AD-1353473.1 | 69.5 | 12.8 | 81.70 | 4.74 | 73.09 | 4.34 | 96.57 | 7.16 |
| AD-1353443.1 | 56.0 | 5.3 | 47.76 | 1.37 | 60.14 | 2.14 | 78.45 | 2.90 |
| AD-1353506.1 | 125.4 | 15.1 | 72.10 | 10.55 | 98.53 | 31.92 | 139.95 | 25.71 |
| AD-1353476.1 | 31.1 | 0.9 | 52.33 | 18.02 | 53.46 | 8.06 | 81.81 | 20.46 |
| AD-1353446.1 | 33.5 | 3.9 | 49.43 | 19.14 | 48.57 | 12.81 | 89.09 | 18.37 |
| AD-1353497.1 | 73.7 | 15.2 | 76.17 | 18.94 | 110.55 | 19.54 | 108.38 | 14.24 |
| AD-1353467.1 | 24.1 | 1.6 | 68.83 | 36.91 | 60.52 | 9.05 | 88.11 | 6.79 |
| AD-1353437.1 | 26.6 | 1.3 | 36.54 | 18.99 | 58.73 | 11.11 | 78.39 | 13.30 |
| AD-1353494.1 | 78.9 | 18.5 | 64.78 | 5.56 | 80.76 | 28.61 | 105.16 | 8.40 |
| AD-1353464.1 | 39.2 | 11.1 | 43.51 | 10.28 | 46.64 | 1.22 | 86.15 | 13.43 |
| AD-1353434.1 | 25.8 | 2.3 | 35.87 | 7.53 | 46.49 | 2.58 | 88.48 | 12.93 |
| AD-1353505.1 | 79.3 | 14.0 | 90.37 | 26.82 | 88.87 | 9.99 | 118.05 | 27.89 |
| AD-1353475.1 | 45.8 | 4.4 | 81.74 | 24.42 | 61.65 | 9.73 | 113.65 | 24.35 |
| AD-1353445.1 | 33.1 | 4.6 | 34.12 | 2.32 | 58.71 | 12.42 | 76.70 | 5.84 |
| AD-1353518.1 | 106.7 | 9.5 | 66.77 | 10.60 | 101.34 | 19.91 | 116.14 | 13.23 |
| AD-1353490.1 | 57.6 | 2.9 | 65.55 | 2.51 | 59.72 | 1.89 | 82.32 | 10.94 |
| AD-1353460.1 | 43.3 | 2.2 | 57.20 | 17.51 | 57.83 | 6.41 | 81.60 | 3.42 |
| AD-1353512.1 | 49.3 | 2.8 | 56.05 | 16.30 | 73.12 | 5.01 | 80.00 | 12.61 |
| AD-1353482.1 | 31.8 | 7.0 | 41.02 | 4.08 | 49.87 | 13.58 | 75.30 | 11.76 |
| AD-1353452.1 | 22.0 | 0.8 | 27.69 | 6.99 | 49.18 | 8.36 | 64.25 | 8.77 |
| AD-1353501.1 | 93.4 | 14.4 | 73.05 | 23.54 | 91.52 | 22.64 | 118.07 | 3.73 |
| AD-1353471.1 | 35.3 | 16.6 | 55.66 | 10.36 | 62.03 | 8.43 | 74.30 | 10.30 |
| AD-1353441.1 | 42.8 | 12.1 | 37.07 | 2.05 | 55.05 | 11.83 | 87.87 | 11.35 |
| AD-1353495.1 | 64.9 | 6.6 | 57.36 | 3.08 | 76.11 | 7.59 | 91.83 | 2.54 |
| AD-1353465.1 | 46.1 | 9.0 | 52.06 | 2.82 | 71.33 | 9.34 | 96.77 | 3.94 |
| AD-1353435.1 | 26.6 | 0.6 | 34.92 | 2.32 | 52.83 | 10.26 | 75.24 | 2.38 |
| AD-1353510.1 | 119.8 | 18.1 | 101.24 | 29.18 | 93.46 | 10.24 | 113.16 | 12.92 |
| AD-1353480.1 | 31.4 | 6.3 | 39.32 | 0.42 | 41.34 | 14.17 | 67.02 | 5.59 |
| AD-1353450.1 | 34.6 | 7.4 | 66.32 | 23.95 | 50.20 | 0.35 | 73.85 | 1.29 |
| AD-1353492.1 | 77.7 | 10.8 | 71.56 | 11.36 | 77.86 | 8.02 | 121.84 | 4.81 |
| AD-1353462.1 | 77.9 | 8.7 | 61.05 | 3.21 | 84.55 | 11.04 | 95.78 | 4.27 |
| AD-1353432.1 | 53.3 | 2.4 | 54.18 | 15.15 | 77.02 | 10.61 | 91.59 | 3.58 |
| AD-1353504.1 | 112.3 | 16.9 | 103.54 | 22.58 | 96.95 | 21.25 | 104.68 | 1.67 |
| AD-1353474.1 | 37.3 | 0.8 | 45.61 | 7.93 | 64.86 | 13.55 | 90.57 | 9.24 |
| AD-1353444.1 | 34.6 | 2.7 | 46.49 | 12.28 | 64.50 | 3.69 | 90.43 | 15.39 |
| AD-1353493.1 | 115.2 | 3.5 | 109.69 | 24.35 | 115.11 | 15.22 | 148.20 | 6.03 |
| AD-1353463.1 | 37.4 | 10.6 | 39.98 | 1.58 | 67.51 | 13.18 | 101.55 | 10.32 |
| AD-1353433.1 | 41.6 | 2.6 | 49.27 | 11.07 | 57.69 | 7.11 | 85.23 | 1.77 |
| AD-1353508.1 | 99.1 | 18.5 | 108.35 | 7.54 | 119.28 | 22.06 | 127.04 | 26.81 |
| AD-1353478.1 | 61.3 | 7.9 | 80.29 | 6.74 | 84.40 | 5.07 | 106.24 | 18.11 |
| AD-1353448.1 | 46.8 | 10.5 | 45.28 | 0.83 | 70.79 | 13.97 | 93.49 | 2.61 |
| AD-1353496.1 | 71.4 | 11.4 | 72.67 | 26.10 | 75.08 | 10.38 | 78.24 | 0.83 |
| AD-1353466.1 | 27.1 | 2.2 | 41.23 | 4.27 | 46.93 | 8.96 | 74.57 | 10.13 |
| AD-1353436.1 | 34.3 | 12.7 | 44.21 | 16.99 | 76.15 | 17.23 | 100.46 | 13.86 |
| AD-1353500.1 | 93.3 | 10.4 | 71.79 | 21.42 | 90.97 | 13.97 | 121.98 | 8.36 |
| AD-1353470.1 | 56.5 | 18.5 | 68.60 | 21.85 | 66.08 | 16.35 | 98.20 | 16.07 |
| AD-1353440.1 | 42.7 | 13.9 | 32.74 | 2.42 | 47.72 | 4.01 | 87.22 | 13.60 |
| AD-1334067.3 | 62.0 | 5.0 | 66.03 | 15.65 | 104.31 | 6.24 | 118.77 | 15.26 |

TABLE 11-continued

VEGF-A endogenous in vitro multi-dose screen following cellular transfection with additional set of exemplary human VEGF-A siRNAs

| | 50 nM dose | | 10 nM dose | | 1 nM dose | | 0.1 nM dose | |
|---|---|---|---|---|---|---|---|---|
| Duplex | Avg | SD | Avg | SD | Avg | SD | Avg | SD |
| AD-1353488.1 | 45.4 | 9.5 | 54.95 | 18.87 | 66.30 | 5.64 | 93.92 | 6.82 |
| AD-1353458.1 | 49.9 | 2.7 | 42.68 | 4.29 | 52.79 | 7.82 | 86.26 | 5.91 |
| AD-1334065.3 | 71.1 | 12.6 | 78.09 | 22.23 | 84.66 | 18.18 | 114.25 | 13.96 |
| AD-1353487.1 | 34.9 | 4.5 | 66.90 | 18.73 | 56.96 | 8.69 | 78.72 | 9.61 |
| AD-1353457.1 | 38.2 | 9.3 | 58.10 | 28.97 | 54.23 | 13.92 | 72.52 | 6.80 |
| AD-1353511.1 | 83.9 | 11.7 | 62.66 | 20.11 | 82.39 | 4.29 | 108.94 | 17.57 |
| AD-1353481.1 | 37.4 | 5.3 | 33.15 | 14.70 | 53.45 | 6.54 | 89.49 | 20.18 |
| AD-1353451.1 | 36.5 | 3.0 | 50.19 | 3.34 | 70.69 | 2.05 | 89.11 | 5.24 |
| AD-1353507.1 | 88.8 | 24.1 | 103.80 | 3.43 | 118.16 | 22.78 | 109.81 | 8.53 |
| AD-1353477.1 | 58.1 | 13.7 | 71.67 | 24.75 | 89.22 | 12.01 | 97.98 | 5.38 |
| AD-1353447.1 | 35.9 | 5.8 | 35.44 | 0.37 | 69.83 | 7.21 | 93.70 | 5.60 |
| AD-1353517.1 | 81.4 | 27.8 | 65.25 | 15.18 | 87.98 | 15.64 | 87.33 | 5.55 |
| AD-1353489.1 | 39.1 | 8.5 | 48.80 | 14.60 | 53.72 | 2.50 | 78.25 | 4.63 |
| AD-1353459.1 | 36.3 | 3.0 | 42.48 | 5.66 | 55.07 | 0.79 | 88.61 | 15.57 |
| AD-1353519.1 | 99.4 | 27.7 | 81.48 | 9.81 | 93.30 | 21.44 | 129.30 | 24.38 |
| AD-1353491.1 | 49.6 | 22.3 | 68.94 | 16.28 | 84.63 | 0.34 | 82.41 | 4.90 |
| AD-1353461.1 | 36.0 | 7.6 | 42.22 | 11.83 | 52.71 | 11.40 | 75.56 | 6.49 |

Example 3. In Vivo Screening of VEGF-A siRNA

Figure 3A:
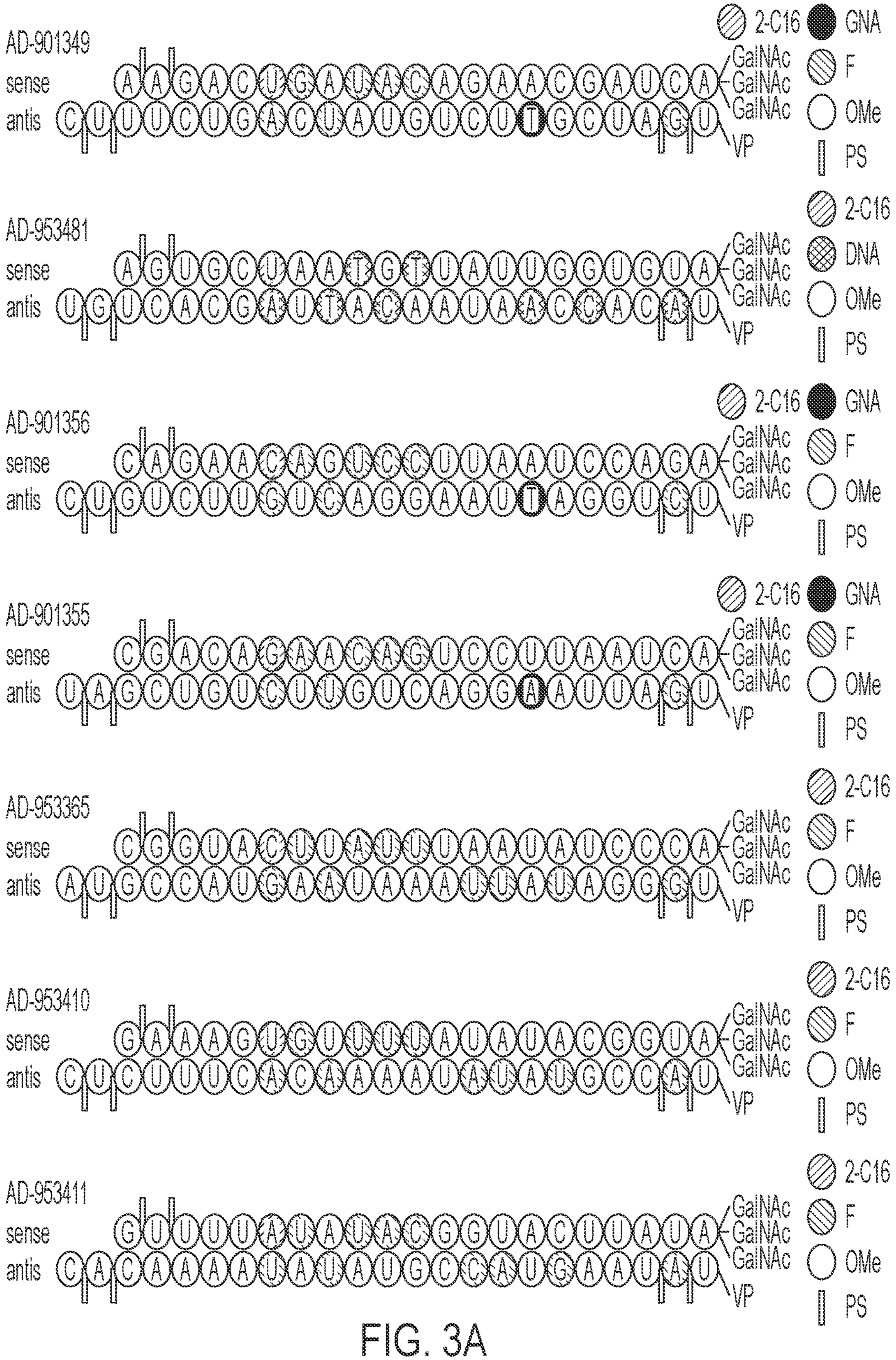
FIG. 3A depicts the sequences and chemistry of the exemplary VEGF-A siRNAs including AD-901349 (SEQ ID NO: 4156 and 130), AD-953481 (SEQ ID NO: 1038 and 1168), AD-901356 (SEQ ID NO: 3 and 132), AD-901355 (SEQ ID NO: 4 and 133), AD-953365 (SEQ ID NO: 552 and 682), AD-953410 (SEQ ID NO: 585 and 715), AD-953411 (SEQ ID NO: 584 and 714).
Figure 3B:
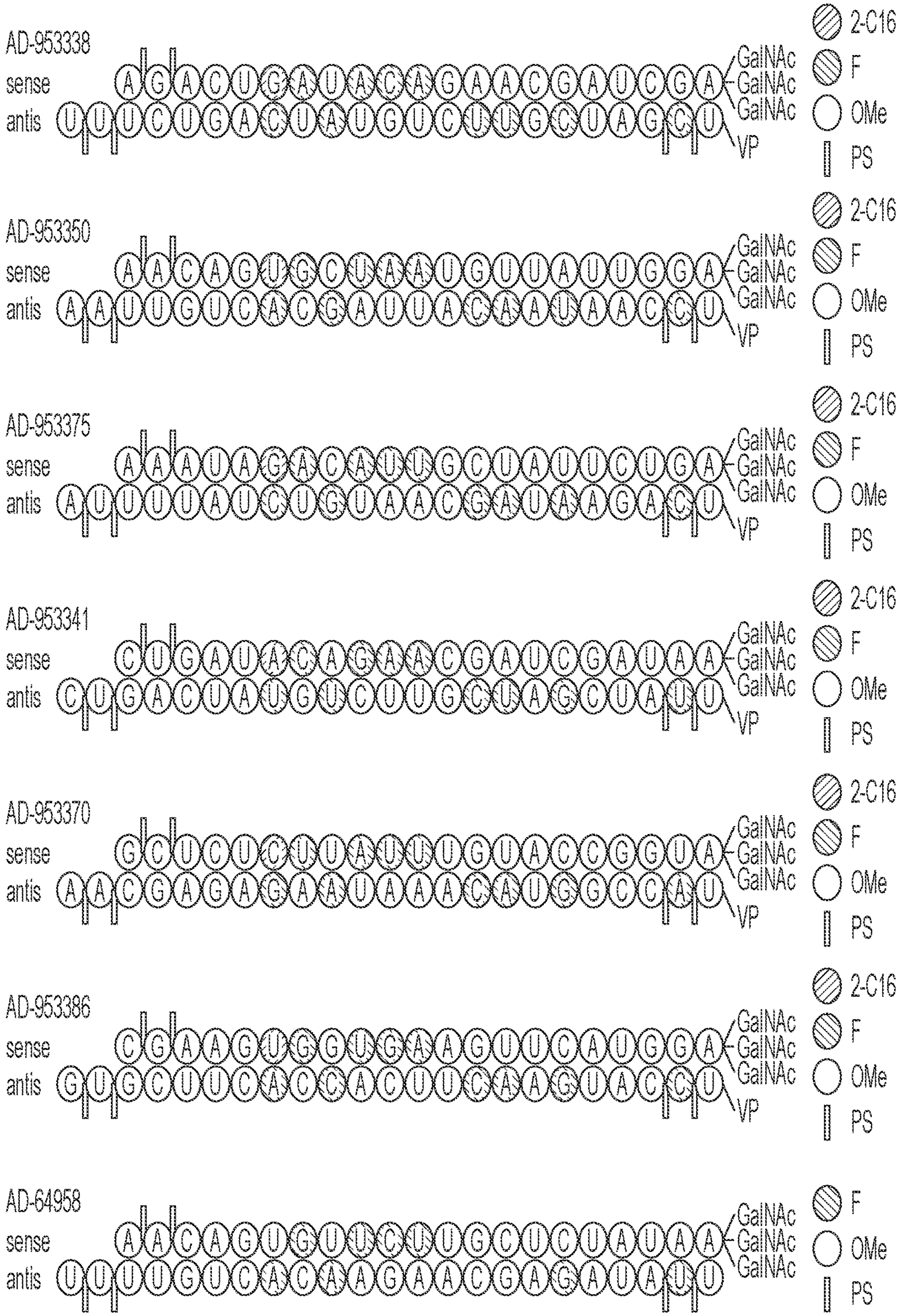
FIG. 3B depicts the sequences and chemistry of the exemplary VEGF-A siRNAs including AD-953338 (SEQ ID NO: 520 and 650), AD-953350 (SEQ ID NO: 524 and 654), AD-953375 (SEQ ID NO: 530 and 660), AD-953341 (SEQ ID NO: 532 and 662), AD-953370 (SEQ ID NO: 533 and 663), AD-953386 (SEQ ID NO: 541 and 671), AD-64958 (SEQ ID NO: 5003 and 5004). For each siRNA, “F” is the “2'-fluoro” modification, OMe is a methoxy group, GNA refers to a glycol nucleic acid, 2-C16 refers to the targeting ligand, and PS refers to the phosphorothioate linkage.
Figure 5A:
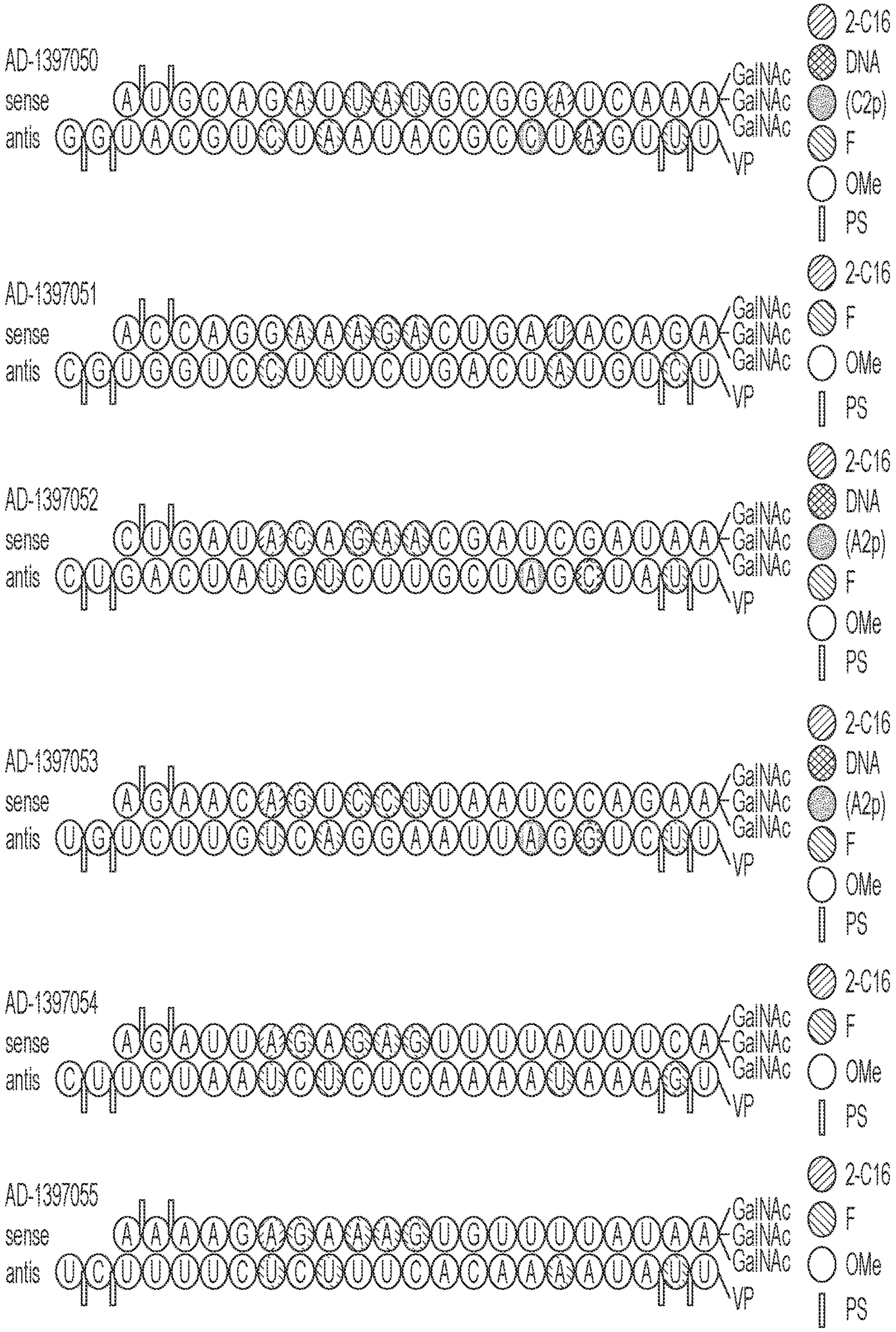
FIG. 5A depicts the sequences and chemistry of the exemplary VEGF-A siRNAs including AD-1397050 (SEQ ID NO: 5005 and 3936), AD-1397051 (SEQ ID NO: 5006 and 3918), AD-1397052 (SEQ ID NO: 10 and 3957), AD-1397053 (SEQ ID NO: 5007 and 3924), AD-1397054 (SEQ ID NO: 5008 and 2640), AD-1397055 (SEQ ID NO: 5009 and 2775).
Figure 5B:
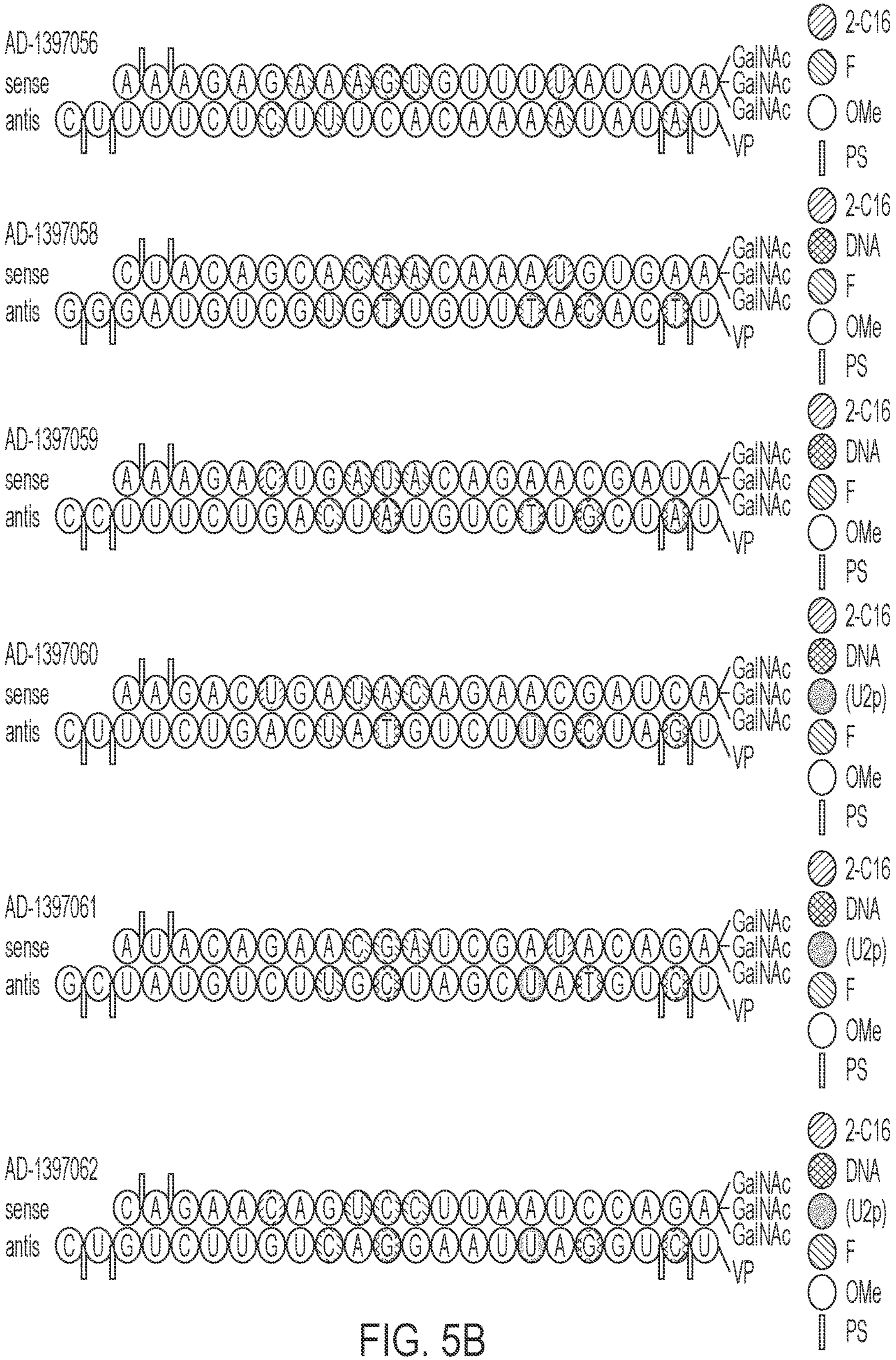
FIG. 5B depicts the sequences and chemistry of the exemplary VEGF-A siRNAs including AD-1397056 (SEQ ID NO: 5010 and 2776), AD-1397058 (SEQ ID NO: 5011 and 3953), AD-1397059 (SEQ ID NO: 5012 and 3889), AD-1397060 (SEQ ID NO: 5013 and 3902), AD-1397061 (SEQ ID NO: 5014 and 3932), and AD-1397062 (SEQ ID NO: 5015 and 3944).
Figure 5C:
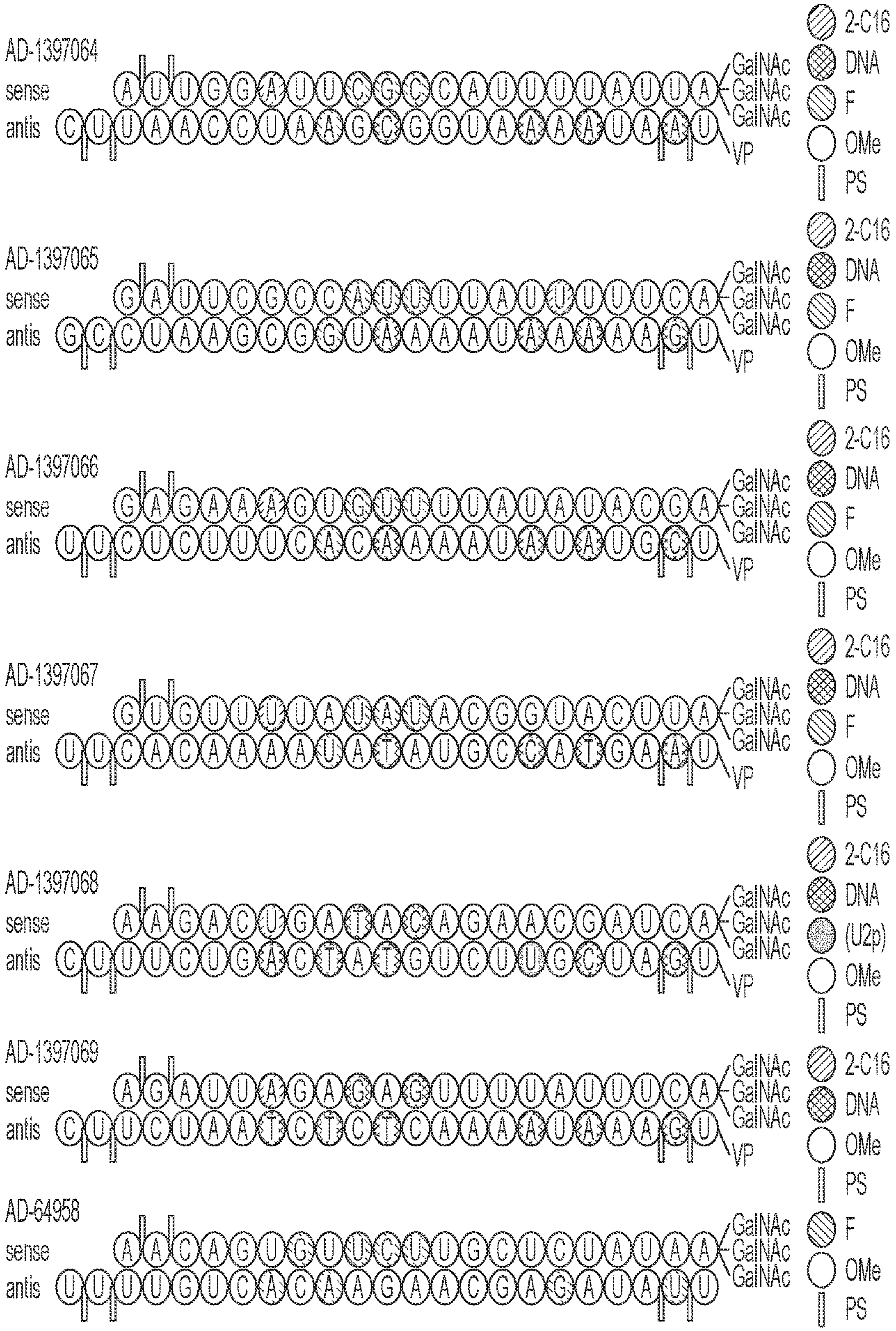
FIG. 5C depicts the sequences and chemistry of the exemplary VEGF-A siRNAs including AD-1397064 (SEQ ID NO: 5016 and 3938), AD-1397065 (SEQ ID NO: 5017 and 3965), AD-1397066 (SEQ ID NO: 5018 and 3962), AD-1397067 (SEQ ID NO: 5019 and 3971), AD-1397068 (SEQ ID NO: 1044 and 3901), AD-1397069 (SEQ ID NO: 5020 and 3928), and AD-64958 (SEQ ID NO: 5003 and 5004). For each siRNA, “F” is the “2'-fluoro” modification, OMe is a methoxy group, GNA refers to a glycol nucleic acid, “(A2p)” refers to adenosine 2'-phosphate, “(C2p)” refers to cytosine 2'-phosphate, “(U2p)” refers to uracil 2'-phosphate, “DNA” refers to a DNA base, 2-C16 refers to the targeting ligand, and PS refers to the phosphorothioate linkage.

This Example investigates the effects of the exemplary VEGF-A targeting siRNAs for in vivo efficacy for human VEGF-A knockdown in AAV mice. The first exemplary set of VEGF-A targeting siRNAs investigated includes AD-64228, AD-953374, AD-953504, AD-953336, AD-953337, AD-901376, AD-953364, AD-953340, AD-953351, AD-953342, AD-953308, AD-953344, AD-953339, and AD-953363 (summarized in Table 12 and FIGS. 1A-1B). The second set of exemplary VEGF-A targeting siRNAs investigated included AD-901349, AD-953481, AD-901356, AD-901355, AD-953365, AD-953410, AD-953411, AD-953338, AD-953350, AD-953375, AD-953341, AD-953370, AD-953386, AD-64958 (summarized in Table 13 and FIGS. 3A-3B) The final set of exemplary VEGF-A targeting siRNAs investigated included AD-1397050, AD-1397051, AD-1397052, AD-1397053, AD-1397054, AD-1397055, AD-1397056, AD-1397058, AD-1397059, AD-1397060, AD-1397061, AD-1397062, AD-1397064, AD-1397065, AD-1397066, AD-1397067, AD-1397068, AD-1397069, and AD-64958 (summarized in Table 14 and FIGS. 5A-5C).

TABLE 12

VEGF-A in vivo single-dose screen with one set of exemplary VEGF-A siRNA duplexes. In this table the column "Duplex Name" provides the numerical part of the duplex name. The duplex name can comprise a suffix (number following the decimal point in a duplex name) that merely refers to a batch production number. The suffix can be omitted from the duplex name without changing the chemical structure. For example, duplex AD-953504.1 in Table 4A refers to the same duplex as AD-953504 in Table 12.

| Duplex Name | Strand | Target | Modified Sequence (5'-3') | SEQ ID NO |
|---|---|---|---|---|
| AD-64228 | sense | None | asascaguGfuUfCfUfugcucuauaaL96 | 4162 |
| | anti-sense | mTTR | usUfsauaGfaGfCfaagaAfcAfcuguusus u | 4163 |
| AD-953504 | sense | VEGF-A | asasaau(Ahd)gadCadTugcuauucuaL96 | 1037 |
| | anti-sense | VEGF-A | VPusdAsgadAudAgcaadTgdTcdTauuuusasu | 1167 |
| AD-953308 | sense | VEGF-A | csascca(Uhd)GfcAfGfAfuuaugcggaaL96 | 579 |
| | anti-sense | VEGF-A | VPusUfsccgCfaUfAfaucuGfcAfuggugsasu | 709 |
| AD-953336 | sense | VEGF-A | asasaga(Chd)UfgAfUfAfcagaacgauaL96 | 518 |
| | anti-sense | VEGF-A | VPusAfsucgUfuCfUfguauCfaGfucuuuscsc | 648 |
| AD-953337 | sense | VEGF-A | asasgac(Uhd)GfaUfAfCfagaacgaucaL96 | 522 |
| | anti-sense | VEGF-A | VPusGfsaucGfuUfCfuguaUfcAfgucuususc | 652 |
| AD-953339 | sense | VEGF-A | gsascug(Ahd)UfaCfAfGfaacgaucgaaL96 | 528 |
| | anti-sense | VEGF-A | VPusUfscgaUfcGfUfucugUfaUfcagucsusu | 658 |

TABLE 12-continued

VEGF-A in vivo single-dose screen with one set of exemplary VEGF-A siRNA duplexes. In this table the column "Duplex Name" provides the numerical part of the duplex name. The duplex name can comprise a suffix (number following the decimal point in a duplex name) that merely refers to a batch production number. The suffix can be omitted from the duplex name without changing the chemical structure. For example, duplex AD-953504.1 in Table 4A refers to the same duplex as AD-953504 in Table 12.

| Duplex Name | Strand | Target | Modified Sequence (5'-3') | SEQ ID NO |
|---|---|---|---|---|
| AD-953340 | sense | VEGF-A | ascsuga(Uhd)AfcAfGfAfacgaucgauaL96 | 517 |
| | anti-sense | VEGF-A | VPusAfsucgAfuCfGfuucuGfuAfucaguscsu | 647 |
| AD-953342 | sense | VEGF-A | asusaca(Ghd)AfaCfGfAfucgauacagaL96 | 523 |
| | anti-sense | VEGF-A | VPusCfsuguAfuCfGfaucgUfuCfuguauscsa | 653 |
| AD-953344 | sense | VEGF-A | csasgaa(Chd)AfgUfCfCfuuaauccagaL96 | 527 |
| | anti-sense | VEGF-A | VPusCfsuggAfuUfAfaggaCfuGfuucugsusc | 657 |
| AD-953351 | sense | VEGF-A | asgsugc(Uhd)AfaUfGfUfuauugguguaL96 | 540 |
| | anti-sense | VEGF-A | VPusAfscacCfaAfUfaacaUfuAfgcacusgsu | 670 |
| AD-953363 | sense | VEGF-A | gsasgaa(Ahd)GfuGfUfUfuuauauacgaL96 | 519 |
| | anti-sense | VEGF-A | VPusCfsguaUfaUfAfaaacAfcUfuucucsusu | 649 |
| AD-953364 | sense | VEGF-A | ascsggu(Ahd)CfuUfAfUfuuaauauccaL96 | 567 |
| | anti-sense | VEGF-A | VPusGfsgauAfuUfAfaauaAfgUfaccgusasu | 697 |
| AD-901376 | sense | VEGF-A | ascsggu(Ahd)CfuUfAfUfuuaauauccaL96 | 4157 |
| | anti-sense | VEGF-A | VPusGfsgaua(Tgn)uaaauaAfgUfaccgusasu | 131 |
| AD-953374 | sense | VEGF-A | asasaau(Ahd)GfaCfAfUfugcuauucuaL96 | 553 |
| | anti-sense | VEGF-A | VPusAfsgaaUfaGfCfaaugUfcUfauuuusasu | 683 |

TABLE 13

VEGF-A in vivo single-dose screen with one set of exemplary VEGF-A siRNA duplexes. In this table the column "Duplex Name" provides the numerical part of the duplex name. The duplex name can comprise a suffix (number following the decimal point in a duplex name) that merely refers to a batch production number. The suffix can be omitted from the duplex name without changing the chemical structure. For example, duplex AD-953481.1 in Table 4A refers to the same duplex as AD-953481 in Table 13.

| Duplex Name | Strand | Target | Modified Sequence (5'-3') | SEQ ID NO |
|---|---|---|---|---|
| AD-64958 | sense | None | asascaguGfuUfCfUfugcucuauaaL96 | 5003 |
| | anti-sense | None | usUfsauaGfagcaagaAfcAfcuguususu | 5004 |
| AD-953481 | sense | VEGF-A | asgsugc(Uhd)aadTgdTuauugguguaL96 | 1038 |
| | anti-sense | VEGF-A | VPusdAscadCcdAauaadCadTudAgcacusgsu | 1168 |
| AD-901349 | sense | VEGF-A | asasgac(Uhd)GfaUfAfCfagaacgaucaL96 | 4156 |
| | anti-sense | VEGF-A | VPusGfsaucg(Tgn)ucuguaUfcAfgucuusus c | 130 |
| AD-953338 | sense | VEGF-A | asgsacu(Ghd)AfuAfCfAfgaacgaucgaL96 | 520 |
| | anti-sense | VEGF-A | VPusCfsgauCfgUfUfcuguAfuCfagucususu | 650 |
| AD-953341 | sense | VEGF-A | csusgau(Ahd)CfaGfAfAfcgaucgauaaL96 | 532 |
| | anti-sense | VEGF-A | VPusUfsaucGfaUfCfguucUfgUfaucagsusc | 662 |

TABLE 13-continued

VEGF-A in vivo single-dose screen with one set of exemplary VEGF-A siRNA duplexes. In this table the column "Duplex Name" provides the numerical part of the duplex name. The duplex name can comprise a suffix (number following the decimal point in a duplex name) that merely refers to a batch production number. The suffix can be omitted from the duplex name without changing the chemical structure. For example, duplex AD-953481.1 in Table 4A refers to the same duplex as AD-953481 in Table 13.

| Duplex Name | Strand | Target | Modified Sequence (5'-3') | SEQ ID NO |
|---|---|---|---|---|
| AD-901355 | sense | VEGF-A | csgsaca(Ghd)AfaCfAfGfuccuuaaucaL96 | 4 |
| | anti-sense | VEGF-A | VPusGfsauua(Agn)ggacugUfuCfugucgsasu | 133 |
| AD-901356 | sense | VEGF-A | csasgaa(Chd)AfgUfCfCfuuaauccagaL96 | 3 |
| | anti-sense | VEGF-A | VPusCfsugga(Tgn)uaaggaCfuGfuucugsusc | 132 |
| AD-953350 | sense | VEGF-A | asascag(Uhd)GfcUfAfAfuguuauuggaL96 | 524 |
| | anti-sense | VEGF-A | VPusCfscaaUfaAfCfauuaGfcAfcuguusasa | 654 |
| AD-953365 | sense | VEGF-A | csgsgua(Chd)UfuAfUfUfuaauaucccaL96 | 552 |
| | anti-sense | VEGF-A | VPusGfsggaUfaUfUfaaauAfaGfuaccgsusa | 682 |
| AD-953370 | sense | VEGF-A | gscsucu(Chd)UfuAfUfUfuguaccgguaL96 | 533 |
| | anti-sense | VEGF-A | VPusAfsccgGfuAfCfaaauAfaGfagagcsasa | 663 |
| AD-953375 | sense | VEGF-A | asasaua(Ghd)AfcAfUfUfgcuauucugaL96 | 530 |
| | anti-sense | VEGF-A | VPusCfsagaAfuAfGfcaauGfuCfuauususa | 660 |
| AD-953386 | sense | VEGF-A | csgsaag(Uhd)GfgUfGfAfaguucauggaL96 | 541 |
| | anti-sense | VEGF-A | VPusCfscauGfaAfCfuucaCfcAfcuucgsusg | 671 |
| AD-953410 | sense | VEGF-A | gsasaag(Uhd)GfuUfUfUfauauacgguaL96 | 585 |
| | anti-sense | VEGF-A | VPusAfsccgUfaUfAfuaaaAfcAfcuuucsusc | 715 |
| AD-953411 | sense | VEGF-A | gsusuuu(Ahd)UfaUfAfCfgguacuuauaL96 | 584 |
| | anti-sense | VEGF-A | VPusAfsuaaGfuAfCfcguaUfaUfaaaacsasc | 714 |

TABLE 14

VEGF-A in vivo single-dose screen with one set of exemplary VEGF-A siRNA duplexes. In this table, the columns "Duplex Name" and "Strand Name" provide the numerical part of the duplex or strand name. The duplex or strand name can comprise a suffix (number following the decimal point in a duplex name) that merely refers to a batch production number. The suffix can be omitted from the duplex name without changing the chemical structure. For example, the antisense strand name A-2521293.1 in Table 10A refers to the same antisense strand as A-2521293 in Table 14.

| Duplex Name | Strand Name | Strand | Target | SEQ ID NO (modified) | Modified Sequence (5'-3') | Unmodified Sequence (5'-3') | SEQID NO (un-modified) |
|---|---|---|---|---|---|---|---|
| AD-64958 | A-128009 | sense | None | 5003 | asascaguGfuUfCfUfugcucuauaaL96 | AACAGUGUUCUUGCUCUAUAA | 5021 |
| | A-126312 | anti-sense | None | 5004 | usUfsauaGfagcaagaAfcAfcuguususu | UUAUAGAGCAAGAACACUGUUUU | 5022 |
| AD-1397068 | A-1700995 | sense | VEGF-A | 1044 | asasgac(Uhd)gadTadCagaacgaucaL96 | AAGACUGAUACAGAACGAUCA | 1304 |
| | A-2521293 | anti-sense | VEGF-A | 3901 | VPusdGsaudCg(U2p)ucugdTadTcdAgucuUSUSC | UGAUCGUUCUGUAUCAGUCUUUC | 4081 |

TABLE 14-continued

VEGF-A in vivo single-dose screen with one set of exemplary VEGF-A siRNA duplexes. In this table, the columns "Duplex Name" and "Strand Name" provide the numerical part of the duplex or strand name. The duplex or strand name can comprise a suffix (number following the decimal point in a duplex name) that merely refers to a batch production number. The suffix can be omitted from the duplex name without changing the chemical structure. For example, the antisense strand name A-2521293.1 in Table 10A refers to the same antisense strand as A-2521293 in Table 14.

| Duplex Name | Strand Name | Strand | Target | SEQ ID NO (modified) | Modified Sequence (5'-3') | Unmodified Sequence (5'-3') | SEQID NO (un-modified) |
|---|---|---|---|---|---|---|---|
| AD-1397052 | A-1701263 | sense | VEGF-A | 10 | csusgau(Ahd)CfaGfAfAfcgaucgauaaL96 | CUGAUACAGAACGAUCGAUAA | 268 |
| | A-2521192 | anti-sense | VEGF-A | 3957 | VPusUfsaudCg(A2p)ucguucUfgUfaucagsuse | UUAUCGAUCGUUCUGUAUCAGUC | 4137 |
| AD-1397050 | A-2600337 | sense | VEGF-A | 5005 | asusgcagAfuUfAfUfgcgg(Ahd)ucaaaL96 | AUGCAGAUUAUGCGGAUCAAA | 5023 |
| | A-2521186 | anti-sense | VEGF-A | 3936 | VPusUfsugdAu(C2p)cgcauaAfuCfugcausgsg | UUUGAUCCGCAUAAUCUGCAUGG | 4116 |
| AD-1397051 | A-2600338 | sense | VEGF-A | 5006 | ascscaggAfaAfGfAfcuga(Uhd)acagaL96 | ACCAGGAAAGACUGAUACAGA | 5024 |
| | A-2521190 | anti-sense | VEGF-A | 3918 | VPusCfsuguAfucagucuUfuCfcuggusgsc | UCUGUAUCAGUCUUUCCUGGUGC | 4098 |
| AD-1397053 | A-2600339 | sense | VEGF-A | 5007 | asgsaac(Ahd)GfuCfCfUfuaauccagaaL96 | AGAACAGUCCUUAAUCCAGAA | 5025 |
| | A-2521200 | anti-sense | VEGF-A | 3924 | VPusUfscudGg(A2p)uuaaggAfcUfguucusgsu | UUCUGGAUUAAGGACUGUUCUGU | 4104 |
| AD-1397054 | A-2600340 | sense | VEGF-A | 5008 | asgsauu(Ahd)GfaGfAfGfuuuuauuucaL96 | AGAUUAGAGAGUUUUAUUUCA | 5026 |
| | A-2282496 | anti-sense | VEGF-A | 2640 | VPusGfsaaaUfaaaacucUfcUfaaucususc | UGAAAUAAAACUCUCUAAUCUUC | 4110 |
| AD-1397055 | A-2600341 | sense | VEGF-A | 5009 | asasaag(Ahd)GfaAfAfGfuguuuuauaaL96 | AAAAGAGAAAGUGUUUUAUAA | 5027 |
| | A-2282766 | anti-sense | VEGF-A | 2775 | VPusUfsauaAfaacacuuUfcUfcuuuuscsu | UUAUAAAACACUUUCUCUUUUCU | 3673 |
| AD-1397056 | A-2600342 | sense | VEGF-A | 5010 | asasagagAfaAfGfUfguuu(Uhd)auauaL96 | AAAGAGAAAGUGUUUUAUAUA | 5028 |
| | A-2282768 | anti-sense | VEGF-A | 2776 | VPusAfsuauAfaaacacuUfuCfucuuususc | UAUAUAAAACACUUUCUCUUUUC | 3674 |
| AD-1397058 | A-2600344 | sense | VEGF-A | 5011 | csusacagcaCfAfAfcaaa(Uhd)gugaaL96 | CUACAGCACAACAAAUGUGAA | 5029 |
| | A-2521229 | anti-sense | VEGF-A | 3953 | VPusdTscadCadTuugudTgUfgcuguagsgsg | UTCACATUUGUTGUGCUGUAGGG | 4133 |
| AD-1397059 | A-2600345 | sense | VEGF-A | 5012 | asasaga(Chd)ugAfUfAfcagaacgauaL96 | AAAGACUGAUACAGAACGAUA | 5030 |
| | A-2521233 | anti-sense | VEGF-A | 3889 | VPusdAsucdGudTcugudAuCfagucuuuscsc | UAUCGUTCUGUAUCAGUCUUUCC | 4069 |

TABLE 14-continued

VEGF-A in vivo single-dose screen with one set of exemplary VEGF-A siRNA duplexes. In this table, the columns "Duplex Name" and "Strand Name" provide the numerical part of the duplex or strand name. The duplex or strand name can comprise a suffix (number following the decimal point in a duplex name) that merely refers to a batch production number. The suffix can be omitted from the duplex name without changing the chemical structure. For example, the antisense strand name A-2521293.1 in Table 10A refers to the same antisense strand as A-2521293 in Table 14.

| Duplex Name | Strand Name | Strand | Target | SEQ ID NO (modified) | Modified Sequence (5'-3') | Unmodified Sequence (5'-3') | SEQID NO (un-modified) |
|---|---|---|---|---|---|---|---|
| AD-1397060 | A-2600346 | sense | VEGF-A | 5013 | asasgac(Uhd)gaUfAfCfagaacgaucaL96 | AAGACUGAUACAGAACGAUCA | 5031 |
| | A-2521235 | anti-sense | VEGF-A | 3902 | VPusdGsaudCg(U2p)ucugdTaUfcagucuususe | UGAUCGUUCUGUAUCAGUCUUUC | 5039 |
| AD-1397061 | A-2600347 | sense | VEGF-A | 5014 | asusacagaaCfGfAfucga(Uhd)acagaL96 | AUACAGAACGAUCGAUACAGA | 5032 |
| | A-2521239 | anti-sense | VEGF-A | 3932 | VPusdCsugdTa(U2p)cgaudCgUfucuguausesg | UCUGUAUCGAUCGUUCUGUAUCG | 4112 |
| AD-1397062 | A-2600348 | sense | VEGF-A | 5015 | csasgaa(Chd)agUfCfCfuuaaauccagaL96 | CAGAACAGUCCUUAAUCCAGA | 5033 |
| | A-2521245 | anti-sense | VEGF-A | 3944 | VPusdCsugdGa(U2p)uaagdGaCfuguucugsuse | UCUGGAUUAAGGACUGUUCUGUC | 4124 |
| AD-1397064 | A-2600350 | sense | VEGF-A | 5016 | asusugg(Ahd)uuCfGfCfcauuuuauuaL96 | AUUGGAUUCGCCAUUUUAUUA | 5034 |
| | A-2521257 | anti-sense | VEGF-A | 3938 | VPusdAsaudAadAauggdCgAfauccaausuc | UAAUAAAAUGGCGAAUCCAAUUC | 4118 |
| AD-1397065 | A-2600351 | sense | VEGF-A | 5017 | gsasuucgccAfUfUfuuau(Uhd)uuucaL96 | GAUUCGCCAUUUUAUUUUCA | 5035 |
| | A-2521259 | anti-sense | VEGF-A | 3965 | VPusdGsaadAadAuaaadAuGfgcgaaucscsg | UGAAAAAUAAAAUGGCGAAUCCG | 4145 |
| AD-1397066 | A-2600352 | sense | VEGF-A | 5018 | gsasgaa(Ahd)guGfUfUfuuauauacgaL96 | GAGAAAGUGUUUUAUAUACGA | 5036 |
| | A-2521271 | anti-sense | VEGF-A | 3962 | VPusdCsgudAudAuaaadAcAfcuuucucsusu | UCGUAUAUAAAACACUUUCUCUU | 4142 |
| AD-1397067 | A-2600353 | sense | VEGF-A | 5019 | gsusguu(Uhd)uaUfAfUfacgguacuuaL96 | GUGUUUUAUAUACGGUACUUA | 5037 |
| | A-2521275 | anti-sense | VEGF-A | 3971 | VPusd AsagdT adCcguadTaUfaaaacacsusu | UAAGTACCGUATAUAAAACACUU | 4151 |
| AD-1397069 | A-2600354 | sense | VEGF-A | 5020 | asgsauu(Ahd)gadGadGuuuuauuucaL96 | AGAUUAGAGAGUUUUAUUUCA | 5038 |
| | A-2521319 | anti-sense | VEGF-A | 3928 | VPusdGsaadAudAaaacdTcdTcdTaaucusUsc | UGAAAUAAAACTCTCTAAUCUUC | 4108 |

Experimental Methods

An AAV vector harboring *Homo sapiens* VEGF-A was injected in 6-8 week old C57BL/6 female mice ($2\times10^{11}$ viral particles/mouse), and at 14 days post-AAV administration, a selected siRNA or a control agent were subcutaneously injected at 3 mg/kg in mice (n=3 per group). Mice were sacrificed and their livers were assessed for VEGF-A mRNA levels at 14 days post-injection of the siRNAs or control.

Results

Figure 2:
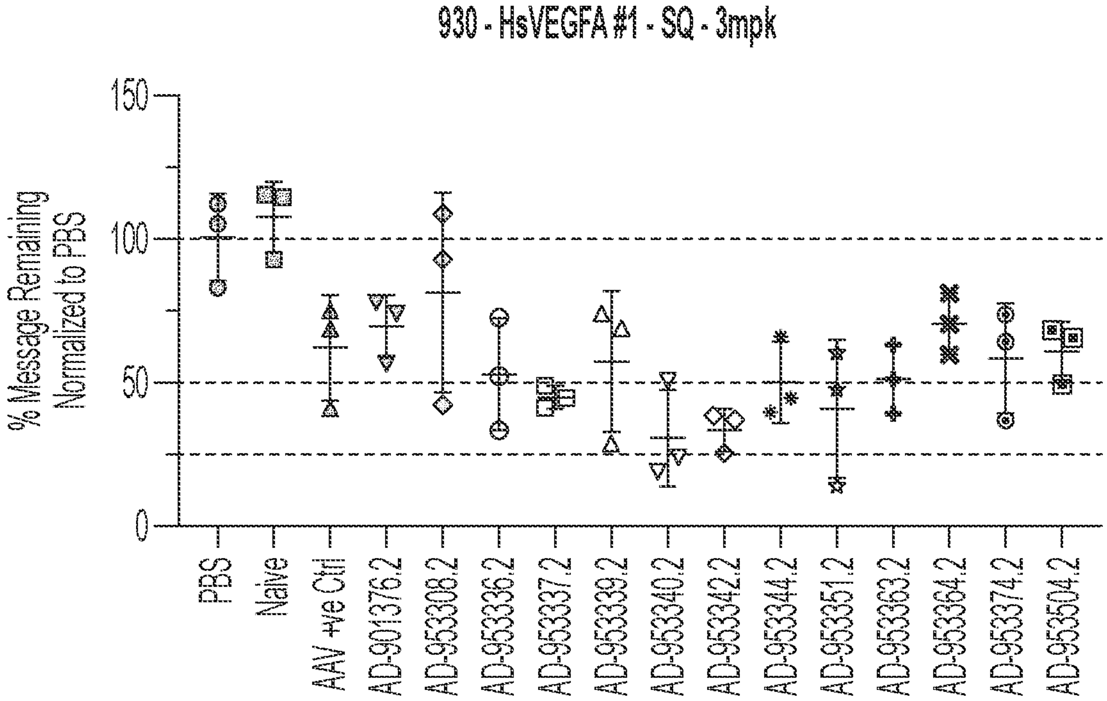
FIG. 2 is a graph depicting the percent VEGF-A message remaining normalized to PBS in mice on day 14 post-treatment with the exemplary duplexes indicated on the X-axis (from left to right: PBS control, naïve control, AAV positive control (AD-64228), AD-901376.2, AD-953308.2, AD-953336.2, AD-953337.2, AD-953339.2, AD-953340.2, AD-953342.2, AD-953344.2, AD-953351.2, AD-953363.2, AD-953364.2, AD-953374.2, AD-953504.2).

Table 15 and FIG. 2 demonstrate the results of the in vivo screen with the siRNA duplexes corresponding to the siRNA sequences in Table 12. Of the siRNA duplexes evaluated in vivo in Table 15, 2 achieved a knockdown of VEGF-A of ≥60%, 4 achieved a knockdown of VEGF-A of ≥50%, 9 achieved a knockdown of VEGF-A of ≥40%, 11 achieved a knockdown of VEGF-A of ≥30%, and 13 achieved a knockdown of VEGF-A of ≥15%.

TABLE 15

Efficacy of exemplary VEGF-A siRNAs in mice. In this table the column "Duplex Name" provides the numerical part of the duplex name with a suffix (number following the decimal point in a duplex name) that merely refers to a batch production number. The suffix can be omitted from the duplex name without changing the chemical structure. For example, duplex AD-953504 in Table 12 refers to the same duplex as AD-953504.2 in Table 15.

| | Day 14 post-treatment | |
|---|---|---|
| Duplex (Administered at 3 mg/kg) | % VEGF-A Message Remaining | St Dev |
| PBS | 101.85 | 21.59 |
| Naïve | 106.47 | 14.34 |
| AD-64228.39 | 62.99 | 16.53 |
| AD-901376.2 | 72.86 | 10.62 |
| AD-953308.2 | 81.89 | 34.49 |
| AD-953336.2 | 51.31 | 16.11 |
| AD-953337.2 | 44.93 | 5.57 |
| AD-953339.2 | 58.33 | 25.29 |
| AD-953340.2 | 33.05 | 18.66 |
| AD-953342.2 | 35.97 | 8.19 |
| AD-953344.2 | 56.71 | 14.45 |
| AD-953351.2 | 43.75 | 29.11 |
| AD-953363.2 | 52.28 | 10.56 |
| AD-953364.2 | 69.25 | 10.87 |
| AD-953374.2 | 59.51 | 18.65 |
| AD-953504.2 | 63.66 | 10.61 |

Figure 4:
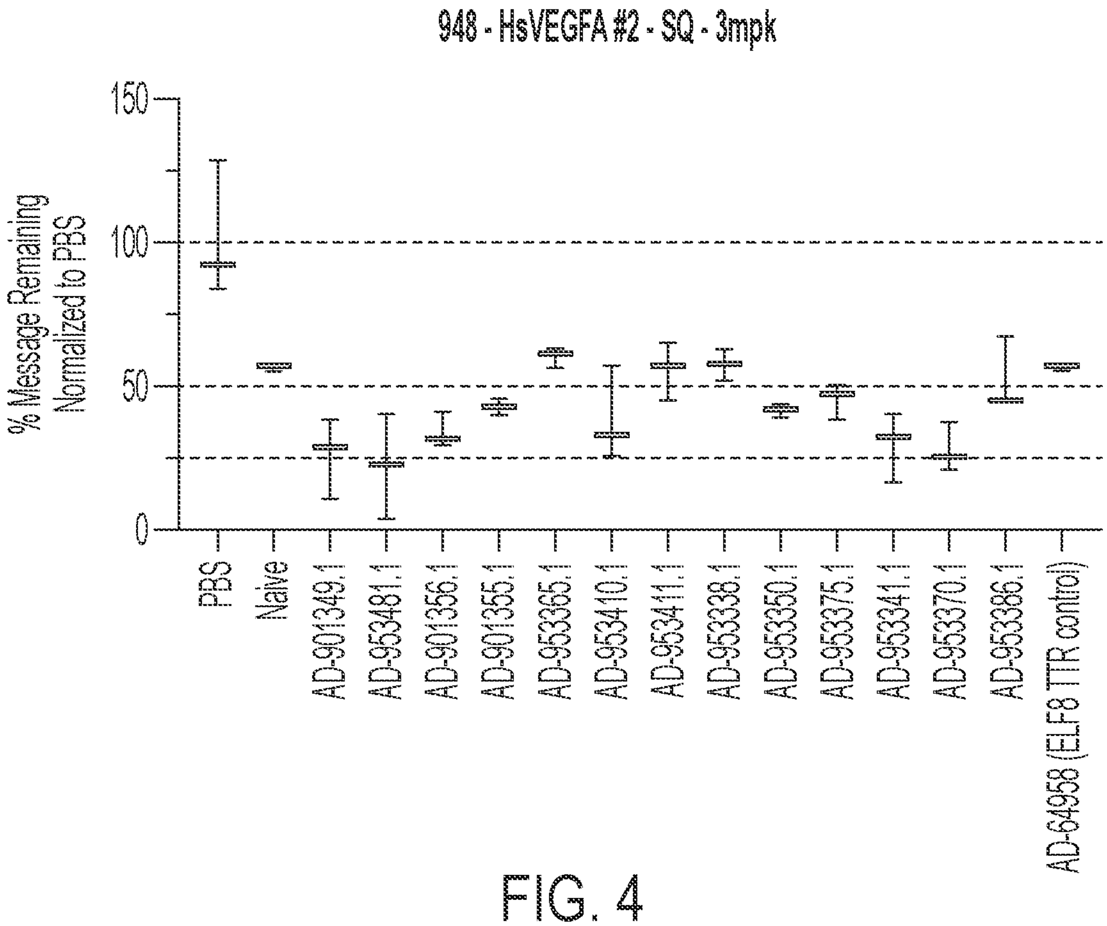
FIG. 4 is a graph depicting the percent VEGF-A message remaining normalized to PBS in mice on day 14 post-treatment with the exemplary duplexes indicated on the X-axis (from left to right: PBS control, naïve control, AD-901349.1, AD-953481.1, AD-901356.1, AD-901355.1, AD-953365.1, AD-953410.1, AD-953411.1, AD-953338.1, AD-953350.1, AD-953375.1, AD-953341.1, AD-953370.1, AD-953386.1, and AD-64958 (ELF8 TTR control).

Table 16 and FIG. 4 demonstrate the results of the in vivo screen with the siRNA duplexes corresponding to the siRNA sequences in Table 13. Of the siRNA duplexes evaluated in vivo in Table 16, 3 achieved a knockdown of VEGF-A of ≥70%, 6 achieved a knockdown of VEGF-A of ≥60%, 9 achieved a knockdown of VEGF-A of ≥50%, 12 achieved a knockdown of VEGF-A of ≥40%, and 13 achieved a knockdown of VEGF-A of ≥30%.

TABLE 16

Efficacy of exemplary VEGF-A siRNAs in mice. In this table the column "Duplex Name" provides the numerical part of the duplex name with a suffix (number following the decimal point in a duplex name) that merely refers to a batch production number. The suffix can be omitted from the duplex name without changing the chemical structure. For example, duplex AD-901349 in Table 13 refers to the same duplex as AD-901349.1 in Table 16.

| | Day 14 post-treatment | |
|---|---|---|
| Duplex (Administered at 3 mg/kg) | % VEGF-A Message Remaining | St Dev |
| PBS | 102.2 | 24.0 |
| Naïve | 56.8 | 8.9 |
| AD-901349.1 | 26.4 | 14.1 |
| AD-953481.1 | 22.6 | 26.2 |
| AD-901356.1 | 34.5 | 6.4 |

TABLE 16-continued

Efficacy of exemplary VEGF-A siRNAs in mice. In this table the column "Duplex Name" provides the numerical part of the duplex name with a suffix (number following the decimal point in a duplex name) that merely refers to a batch production number. The suffix can be omitted from the duplex name without changing the chemical structure. For example, duplex AD-901349 in Table 13 refers to the same duplex as AD-901349.1 in Table 16.

| | Day 14 post-treatment | |
|---|---|---|
| Duplex (Administered at 3 mg/kg) | % VEGF-A Message Remaining | St Dev |
| AD-901355.1 | 43.0 | 4.4 |
| AD-953365.1 | 60.5 | 3.3 |
| AD-953410.1 | 38.8 | 16.4 |
| AD-953411.1 | 56.2 | 10.5 |
| AD-953338.1 | 58.1 | 5.6 |
| AD-953350.1 | 42.0 | 2.5 |
| AD-953375.1 | 45.6 | 6.1 |
| AD-953341.1 | 30.1 | 12.4 |
| AD-953370.1 | 28.3 | 8.5 |
| AD-953386.1 | 52.9 | 13.3 |
| AD-64958 (ELF8 TTR control) | 57.1 | 6.1 |

Figure 6:
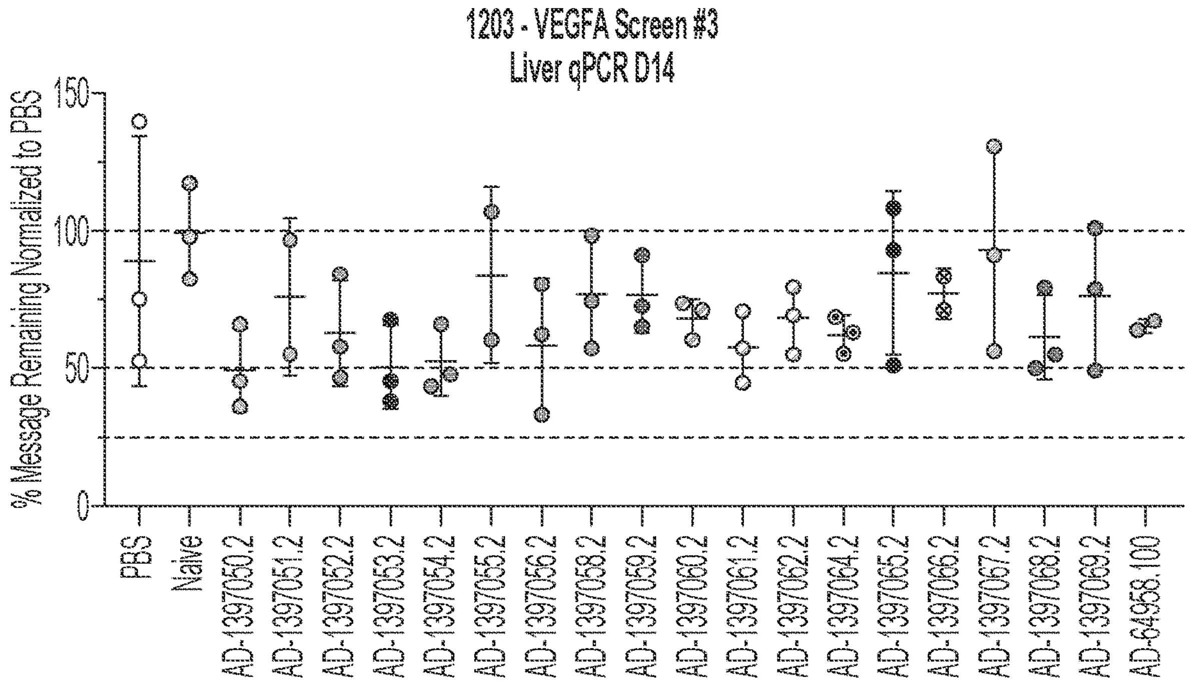
FIG. 6 is a graph depicting the percent VEGF-A message remaining normalized to PBS in mice on day 14 post-treatment with the exemplary duplexes indicated on the X-axis (from left to right: PBS control, naïve control, AD-1397050.2, AD-1397051.2, AD-1397052.2, AD-1397053.2, AD-1397054.2, AD-1397055.2, AD-1397056.2, AD-1397058.2, AD-1397059.2, AD-1397060.2, AD-1397061.2, AD-1397062.2, AD-1397064.2, AD-1397065.2, AD-1397066.2, AD-1397067.2, AD-1397068.2, AD-1397069.2, and AD-64958.100.

Table 17 and FIG. 6 demonstrate the results of the in vivo screen with the siRNA duplexes corresponding to the siRNA sequences in Table 14. Of the siRNA duplexes evaluated in vivo in Table 17, 5 achieved a knockdown of VEGF-A of ≥40%, 10 achieved a knockdown of VEGF-A of ≥30%, 15 achieved a knockdown of VEGF-A of ≥20%, and 17 achieved a knockdown of VEGF-A of ≥10%.

TABLE 17

Efficacy of exemplary VEGF-A siRNAs in mice. In this table the column "Duplex Name" provides the numerical part of the duplex name with a suffix (number following the decimal point in a duplex name) that merely refers to a batch production number. The suffix can be omitted from the duplex name without changing the chemical structure. For example, duplex AD-1397050 in Table 14 refers to the same duplex as AD-1397050.2 in Table 17.

| | Day 14 post-treatment | |
|---|---|---|
| Duplex (Administered at 3 mg/kg) | % VEGF-A Message Remaining | St Dev |
| PBS | 89.7 | 45.3 |
| Naïve | 100.0 | 17.4 |
| AD-1397050.2 | 50.1 | 15.3 |
| AD-1397051.2 | 76.7 | 28.9 |
| AD-1397052.2 | 63.6 | 19.6 |
| AD-1397053.2 | 50.9 | 15.6 |
| AD-1397054.2 | 53.0 | 12.1 |
| AD-1397055.2 | 84.4 | 32.4 |
| AD-1397056.2 | 59.2 | 23.8 |
| AD-1397058.2 | 77.5 | 20.7 |
| AD-1397059.2 | 77.1 | 13.4 |
| AD-1397060.2 | 68.9 | 6.8 |
| AD-1397061.2 | 58.2 | 12.9 |
| AD-1397062.2 | 68.7 | 12.0 |
| AD-1397064.2 | 62.9 | 6.7 |
| AD-1397065.2 | 85.2 | 29.9 |
| AD-1397066.2 | 77.7 | 8.7 |
| AD-1397067.2 | 93.5 | 37.3 |
| AD-1397068.2 | 62.0 | 15.7 |
| AD-1397069.2 | 76.9 | 26.1 |
| AD-64958.100 | 66.0 | 2.6 |

SEQUENCE LISTING (5238 sequences)

SEQ ID NO: 1 - DNA, 3677 bp, Homo sapiens
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtgtacgttggtgcccgctgctgtctaatgccctggagcctccctggcccccatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaa

SEQ ID NO: 2 - DNA, 3677 bp, Homo sapiens
ttttttttttttttttttgagatcagaattaaattctttaatacaaaatgcttttttttttttaagatatatctgtatttctttgtcgttgtttaaaaataaatatgtactacggaatatctcgaaaaactgcactagagacaaagacgtgatgttaatatcttttccccacaattattacggataaacagtagcaccaataaataaatgataacaaatattaaaattaaaaaaggagagagatttagtatgtagaattctctattttttcttgttttgtttttacatataaaaaacagaatagcaatgtctattttatcagaatcacatatatacataaacatatatatatatatatacacacaaatacaagttgccaaatatatatatagtatgtagatgtatattgaaaccttatttcaaaggaatgtgtgctggggagccaggggatcggggagggcagagctgagtgttagcaaaattaaatatctgttcaagataagctagtgactgtcaccgatcagggagagagagattggaaacatgaattttatatacaaaaaccggtacaaataagagagcaagagagagcaaaagatacatctcataaatagttgaaattaaatattaaccaagaatactgaaaaaaaaccctactctttaattaaattaactgttttaatttctaattaaaaagggatattaaataagtaccgtatataaaacactttctcttttctctgcctccacaatgggcacgtggatcctgccctgtctctctgtgcctcgggaagggaagggaaggaccaggggatggaggaaggtcaaccactcacacacacacaaccaggtctcctggggggacagaactagtggtttcaatggtgtgaggacataggtccttttaggctgcaccccaggaaggggagcaggaagaggatgagggcgagtcccaggaaggggagctgtcatgggctgcttcttccaacaatgtgtctcttctcttcgccgggacatctgccagtggtctcctgggcaactcagaagcaggtgagagtaagcgaaggccgcccaggctcctgaatcttccaggcagtgcccctgggggcgagatgcgcgtgcagcatgtggagggaatccccaaagcacagcaatgtcctgaagctccccaaactcctggtcagagccggtgtcctcatccctgtacctgtgatctgtctttctgtccgtctgacctggggtagagaggctcagcgccagggctgggtttgtcggtgttcccaaaactgggtcatatttgcccccatgccctggccttgcacattcctgggcaggggagaggaccctggccccaccaagtgggacaaaaaaaagatcatgccagagtctctcatctcctcctcttccctgtcaggatctgagtgggaacattcccctcccaactcaagtccacagcagtcaaatacatccagtgaagacaccaataacattagcactgttaatttaaaaaaagaatatatatattttatatatataaaatagagatatttatttttatatatatataatatatatatatataaatgtatgtatgtgggtgggtgtgtctacaggaatcccagaaataaaactctctaatcttccgggctcggtgatttagcagcaagaaaaataaaatggcgaatccaattccaagagggaccgtgctgggtcacccgcccgggaatgcttccgccggagtctcgccctccggacccaaagtgctctgcgcagagtctcctcttccttcatttcaggtttctggattaaggactgttctgtcgatggtgatggtgtggtggcggcagcgtggtttctgtatcgatcgttctgtatcagtctttcctggtgagagatctggttcccgaaaccctgagggaggctccttcctcctgcccggctcaccgcctcggcttgtcacatctgcaagtacgttcgtttaactcaagctgcctcgccttgcaacgcgagtctgtgtttttgcaggaacatttacacgtctgcggatcttgtacaaacaaatgctttctccgctctgagcaaggcccacagggatgggggccagggaggctccagggcattagacagcagcgggcaccaacgtacacgctccaggacttataccgggatttcttgcgctttcgtttttgcccctttccctttcctcgaactgattttttttcttgtcttgctctatctttctttggtctgcattcacatttgttgtgctgtaggaagctcatctctcctatgtgctggccttggtgaggtttgatccgcataatctgcatggtgatgttggactcctcagtgggcacacactccaggccctcgtcattgcagcagcccccgcatcgcatcaggggcacacaggatggcttgaagatgtactcgatctcatcagggtactcctggaagatgtccaccagggtctcgattggatggcagtagctgcgctgatagacatccatgaacttcaccacttcgtgatgattctgccctcctccttctgccatgggtgcagcctgggaccacttggcatggtggaggtagagcagcaaggcaaggctccaatgcacccaagacagcagaaagttcatggtttcggaggcccgaccggggccggcgcggctcgcgctccctctccggctcgggctgtggggcggcccgctctcctcggcgcctcggcgagctactcttcctccccggcccgaggcccgggccagggcctggggagcgcgcgcggctggagcactgtctgcgcacaccgccgcctcacccgtccatgagcccggcttccgagcgccgagtcgccactgcggccccctctcctcttccttctcttcttcctcctccccctcctccggctgcggctcctcccggcccgagctagcacttctcgcggctccgctcggctcggcttcccccgcgcggaccacggctcctccgaagcgagaacagcccagaagttggacgaaaagtttcagtgcgacgccgcgagccccgaccccctccaccccgcctccgggcgcgggctccggcccctgcccgcggctcgccgccgcgtccactgtccgccgccggccggggaggaggtggtagctggggctgggggcggtgtctgtctgtctgtccgtcagcgcgactggtcagctgcgggatcccaagggggagggctcacgccgcgctccggcggtcacccccaaaagcaggtcactcactttgcccctgtcgctttcgctgctcgcacgcccgcgcgctctctctgaccccgtctctctcttcctcgacttctctctggagctcttgctacctctttcctctttctgctggtttccaaaatccacagtgatttggggaagtagagcaatctccccaagccgtcggcccgattcaagtggggaatggcaagcaaaaataaattaaaacgagaaacaatacagttttaaaaaaaaatgtttaagaaaaaagaagagggataaaacccggatcaatgaatatcaaattccagcaccgagcgccctggccggtgagtccgctgaccggtccacctaaccgctgcgcctcccgacagagcgctggtgctagcccccagcgccacgacctccgagctacccggctgccccaagcctccgcga

SEQ ID NO: 3 - RNA, 21 nt, Artificial Sequence
  source: /note="Description of Artificial Sequence: Synthetic oligonucleotide"
cagaacaguccuuaauccaga

SEQ ID NO: 4 - RNA, 21 nt, Artificial Sequence
  source: /note="Description of Artificial Sequence: Synthetic oligonucleotide"
cgacagaacaguccuuaauca

SEQ ID NO: 5 - RNA, 21 nt, Artificial Sequence
  source: /note="Description of Artificial Sequence: Synthetic oligonucleotide"
gcauuuguuuguacaagauca

SEQ ID NO: 6 - RNA, 21 nt, Artificial Sequence
  source: /note="Description of Artificial Sequence: Synthetic oligonucleotide"
uauuggugucuucacuggaua

SEQ ID NO: 7 - RNA, 21 nt, Artificial Sequence
  source: /note="Description of Artificial Sequence: Synthetic oligonucleotide"
acugauacagaacgaucgaua

SEQ ID NO: 8 - RNA, 21 nt, Artificial Sequence
  source: /note="Description of Artificial Sequence: Synthetic oligonucleotide"
aaagacugauacagaacgaua

SEQ ID NO: 9 - RNA, 21 nt, Artificial Sequence
  source: /note="Description of Artificial Sequence: Synthetic oligonucleotide"
auacagaacgaucgauacaga

SEQ ID NO: 10 - RNA, 21 nt, Artificial Sequence
  source: /note="Description of Artificial Sequence: Synthetic oligonucleotide"
cugauacagaacgaucgauaa

SEQ ID NO: 11 - RNA, 21 nt, Artificial Sequence
  source: /note="Description of Artificial Sequence: Synthetic oligonucleotide"
gagaaaguguuuuauauacga

SEQ ID NO: 12 - RNA, 21 nt, Artificial Sequence
  source: /note="Description of Artificial Sequence: Synthetic oligonucleotide"
acgaacguacuugcagaugua

SEQ ID NO: 13 - RNA, 21 nt, Artificial Sequence
  source: /note="Description of Artificial Sequence: Synthetic oligonucleotide"
cuuggaauuggauucgccaua

SEQ ID NO: 14 - RNA, 21 nt, Artificial Sequence
  source: /note="Description of Artificial Sequence: Synthetic oligonucleotide"
ggcagcuugaguuaaacgaaa

SEQ ID NO: 15 - RNA, 21 nt, Artificial Sequence
  source: /note="Description of Artificial Sequence: Synthetic oligonucleotide"
gggcagaaucaucacgaagua

SEQ ID NO: 16 - RNA, 21 nt, Artificial Sequence
  source: /note="Description of Artificial Sequence: Synthetic oligonucleotide"
uuaaacgaacguacuugcaga

SEQ ID NO: 17 - RNA, 21 nt, Artificial Sequence
  source: /note="Description of Artificial Sequence: Synthetic oligonucleotide"
guuauuggugucuucacugga

SEQ ID NO: 18 - RNA, 21 nt, Artificial Sequence
  source: /note="Description of Artificial Sequence: Synthetic oligonucleotide"
agcuugaguuaaacgaacgua

SEQ ID NO: 19 - RNA, 21 nt, Artificial Sequence
  source: /note="Description of Artificial Sequence: Synthetic oligonucleotide"
gcagcuugaguuaaacgaaca

SEQ ID NO: 20 - RNA, 21 nt, Artificial Sequence
  source: /note="Description of Artificial Sequence: Synthetic oligonucleotide"
cgaaguggugaaguucaugga

SEQ ID NO: 21 - RNA, 21 nt, Artificial Sequence
  source: /note="Description of Artificial Sequence: Synthetic oligonucleotide"
cagaaucaucacgaaguggua

SEQ ID NO: 22 - RNA, 21 nt, Artificial Sequence
  source: /note="Description of Artificial Sequence: Synthetic oligonucleotide"
aaaauagacauugcuauucua

SEQ ID NO: 23 - RNA, 21 nt, Artificial Sequence
  source: /note="Description of Artificial Sequence: Synthetic oligonucleotide"
cagcuugaguuaaacgaacga

SEQ ID NO: 24 - RNA, 21 nt, Artificial Sequence
  source: /note="Description of Artificial Sequence: Synthetic oligonucleotide"
cgcacugaaacuuuucgucca

SEQ ID NO: 25 - RNA, 21 nt, Artificial Sequence
  source: /note="Description of Artificial Sequence: Synthetic oligonucleotide"
agauuaugcggaucaaaccua

SEQ ID NO: 26 - RNA, 21 nt, Artificial Sequence
  source: /note="Description of Artificial Sequence: Synthetic oligonucleotide"
gcucucuuauuuguaccggua

SEQ ID NO: 27 - RNA, 21 nt, Artificial Sequence
  source: /note="Description of Artificial Sequence: Synthetic oligonucleotide"
ugacagucacuagcuuaucua

SEQ ID NO: 28 - RNA, 21 nt, Artificial Sequence
  source: /note="Description of Artificial Sequence: Synthetic oligonucleotide"
cuugaguuaaacgaacguaca

SEQ ID NO: 29 - RNA, 21 nt, Artificial Sequence
  source: /note="Description of Artificial Sequence: Synthetic oligonucleotide"
agugcuaauguuauuggugua

SEQ ID NO: 30 - RNA, 21 nt, Artificial Sequence
  source: /note="Description of Artificial Sequence: Synthetic oligonucleotide"
auccgcagacguguaaaugua

SEQ ID NO: 31 - RNA, 21 nt, Artificial Sequence
  source: /note="Description of Artificial Sequence: Synthetic oligonucleotide"
agacugauacagaacgaucga

SEQ ID NO: 32 - RNA, 21 nt, Artificial Sequence
  source: /note="Description of Artificial Sequence: Synthetic oligonucleotide"
uguuauuggugucuucacuga

SEQ ID NO: 33 - RNA, 21 nt, Artificial Sequence
  source: /note="Description of Artificial Sequence: Synthetic oligonucleotide"
gugcuggaauuugauauucaa

SEQ ID NO: 34 - RNA, 21 nt, Artificial Sequence
  source: /note="Description of Artificial Sequence: Synthetic oligonucleotide"
uugcugcuaaaucaccgagca

SEQ ID NO: 35 - RNA, 21 nt, Artificial Sequence
  source: /note="Description of Artificial Sequence: Synthetic oligonucleotide"
caccaugcagauuaugcggaa

SEQ ID NO: 36 - RNA, 21 nt, Artificial Sequence
  source: /note="Description of Artificial Sequence: Synthetic oligonucleotide"
gaaagcauuuguuuguacaaa

SEQ ID NO: 37 - RNA, 21 nt, Artificial Sequence
  source: /note="Description of Artificial Sequence: Synthetic oligonucleotide"
gcuugaguuaaacgaacguaa

SEQ ID NO: 38 - RNA, 21 nt, Artificial Sequence
  source: /note="Description of Artificial Sequence: Synthetic oligonucleotide"
ucggugacagucacuagcuua

SEQ ID NO: 39 - RNA, 21 nt, Artificial Sequence
  source: /note="Description of Artificial Sequence: Synthetic oligonucleotide"
aggcagcuugaguuaaacgaa

SEQ ID NO: 40 - RNA, 21 nt, Artificial Sequence
  source: /note="Description of Artificial Sequence: Synthetic oligonucleotide"
cugcaaaaacacagacucgca

SEQ ID NO: 41 - RNA, 21 nt, Artificial Sequence
  source: /note="Description of Artificial Sequence: Synthetic oligonucleotide"
cuugcugcuaaaucaccgaga

SEQ ID NO: 42 - RNA, 21 nt, Artificial Sequence
  source: /note="Description of Artificial Sequence: Synthetic oligonucleotide"
uucuugcugcuaaaucaccga

SEQ ID NO: 43 - RNA, 21 nt, Artificial Sequence
  source: /note="Description of Artificial Sequence: Synthetic oligonucleotide"
aaagcauuuguuuguacaaga

SEQ ID NO: 44 - RNA, 21 nt, Artificial Sequence
  source: /note="Description of Artificial Sequence: Synthetic oligonucleotide"
uccgcagacguguaaauguua

SEQ ID NO: 45 - RNA, 21 nt, Artificial Sequence
  source: /note="Description of Artificial Sequence: Synthetic oligonucleotide"
cgguacuuauuuaauauccca

SEQ ID NO: 46 - RNA, 21 nt, Artificial Sequence
  source: /note="Description of Artificial Sequence: Synthetic oligonucleotide"
gacugauacagaacgaucgaa

SEQ ID NO: 47 - RNA, 21 nt, Artificial Sequence
  source: /note="Description of Artificial Sequence: Synthetic oligonucleotide"
aaaacacagacucgcguugca

SEQ ID NO: 48 - RNA, 21 nt, Artificial Sequence
  source: /note="Description of Artificial Sequence: Synthetic oligonucleotide"
gaguuaaacgaacguacuuga

SEQ ID NO: 49 - RNA, 21 nt, Artificial Sequence
  source: /note="Description of Artificial Sequence: Synthetic oligonucleotide"
ucacuggauguauuugacuga

SEQ ID NO: 50 - RNA, 21 nt, Artificial Sequence
  source: /note="Description of Artificial Sequence: Synthetic oligonucleotide"
ccuccgaaaccaugaacuuua

SEQ ID NO: 51 - RNA, 21 nt, Artificial Sequence
  source: /note="Description of Artificial Sequence: Synthetic oligonucleotide"
uugaguuaaacgaacguacua

SEQ ID NO: 52 - RNA, 21 nt, Artificial Sequence
  source: /note="Description of Artificial Sequence: Synthetic oligonucleotide"
ugcuacuguuuauccguaaua

SEQ ID NO: 53 - RNA, 21 nt, Artificial Sequence
  source: /note="Description of Artificial Sequence: Synthetic oligonucleotide"
ccgcagacguguaaauguuca

SEQ ID NO: 54 - RNA, 21 nt, Artificial Sequence
  source: /note="Description of Artificial Sequence: Synthetic oligonucleotide"
cgcagacguguaaauguucca

SEQ ID NO: 55 - RNA, 21 nt, Artificial Sequence
  source: /note="Description of Artificial Sequence: Synthetic oligonucleotide"
agagaagagacacauuguuga

SEQ ID NO: 56 - RNA, 21 nt, Artificial Sequence
  source: /note="Description of Artificial Sequence: Synthetic oligonucleotide"
acagcacaacaaaugugaaua

SEQ ID NO: 57 - RNA, 21 nt, Artificial Sequence
  source: /note="Description of Artificial Sequence: Synthetic oligonucleotide"
ucuugcugcuaaaucaccgaa

SEQ ID NO: 58 - RNA, 21 nt, Artificial Sequence
  source: /note="Description of Artificial Sequence: Synthetic oligonucleotide"
acaccauugaaaccacuagua

SEQ ID NO: 59 - RNA, 21 nt, Artificial Sequence
  source: /note="Description of Artificial Sequence: Synthetic oligonucleotide"
gaggcagcuugaguuaaacga

SEQ ID NO: 60 - RNA, 21 nt, Artificial Sequence
  source: /note="Description of Artificial Sequence: Synthetic oligonucleotide"
gcacugaaacuuuucguccaa

SEQ ID NO: 61 - RNA, 21 nt, Artificial Sequence
  source: /note="Description of Artificial Sequence: Synthetic oligonucleotide"
guuuuauauacgguacuuaua

SEQ ID NO: 62 - RNA, 21 nt, Artificial Sequence
  source: /note="Description of Artificial Sequence: Synthetic oligonucleotide"
caccauugaaaccacuaguua

SEQ ID NO: 63 - RNA, 21 nt, Artificial Sequence
  source: /note="Description of Artificial Sequence: Synthetic oligonucleotide"
aucaccaugcagauuaugcga

SEQ ID NO: 64 - RNA, 21 nt, Artificial Sequence
  source: /note="Description of Artificial Sequence: Synthetic oligonucleotide"
ugaguuaaacgaacguacuua

SEQ ID NO: 65 - RNA, 21 nt, Artificial Sequence
  source: /note="Description of Artificial Sequence: Synthetic oligonucleotide"
gaaaguguuuuauauacggua

SEQ ID NO: 66 - RNA, 21 nt, Artificial Sequence
  source: /note="Description of Artificial Sequence: Synthetic oligonucleotide"
acagucacuagcuuaucuuga

SEQ ID NO: 67 - RNA, 21 nt, Artificial Sequence
  source: /note="Description of Artificial Sequence: Synthetic oligonucleotide"
gugcuacuguuuauccguaaa

SEQ ID NO: 68 - RNA, 21 nt, Artificial Sequence
  source: /note="Description of Artificial Sequence: Synthetic oligonucleotide"
ccugcaaaaacacagacucga

SEQ ID NO: 69 - RNA, 21 nt, Artificial Sequence
  source: /note="Description of Artificial Sequence: Synthetic oligonucleotide"
caaaaacacagacucgcguua

SEQ ID NO: 70 - RNA, 21 nt, Artificial Sequence
  source: /note="Description of Artificial Sequence: Synthetic oligonucleotide"
ugcuguggacuugaguuggga

SEQ ID NO: 71 - RNA, 21 nt, Artificial Sequence
  source: /note="Description of Artificial Sequence: Synthetic oligonucleotide"
gugcuaauguuauugguguca

SEQ ID NO: 72 - RNA, 21 nt, Artificial Sequence
  source: /note="Description of Artificial Sequence: Synthetic oligonucleotide"
uggugcuacuguuuauccgua

SEQ ID NO: 73 - RNA, 21 nt, Artificial Sequence
  source: /note="Description of Artificial Sequence: Synthetic oligonucleotide"
agaaaguguuuuauauacgga

SEQ ID NO: 74 - RNA, 21 nt, Artificial Sequence
  source: /note="Description of Artificial Sequence: Synthetic oligonucleotide"
aacuauuuaugagauguauca

SEQ ID NO: 75 - RNA, 21 nt, Artificial Sequence
  source: /note="Description of Artificial Sequence: Synthetic oligonucleotide"
aguuaaacgaacguacuugca

SEQ ID NO: 76 - RNA, 21 nt, Artificial Sequence
  source: /note="Description of Artificial Sequence: Synthetic oligonucleotide"
caucuucaagccauccuguga

SEQ ID NO: 77 - RNA, 21 nt, Artificial Sequence
  source: /note="Description of Artificial Sequence: Synthetic oligonucleotide"
uuuuuuuucaguauucuugga

SEQ ID NO: 78 - RNA, 21 nt, Artificial Sequence
  source: /note="Description of Artificial Sequence: Synthetic oligonucleotide"
uuauccguaauaauuguggga

SEQ ID NO: 79 - RNA, 21 nt, Artificial Sequence
  source: /note="Description of Artificial Sequence: Synthetic oligonucleotide"
gguacuuauuuaauaucccua

SEQ ID NO: 80 - RNA, 21 nt, Artificial Sequence
  source: /note="Description of Artificial Sequence: Synthetic oligonucleotide"
cacgucuuugucucuagugca

SEQ ID NO: 81 - RNA, 21 nt, Artificial Sequence
  source: /note="Description of Artificial Sequence: Synthetic oligonucleotide"
ugcaaaaacacagacucgcga

SEQ ID NO: 82 - RNA, 21 nt, Artificial Sequence
  source: /note="Description of Artificial Sequence: Synthetic oligonucleotide"
acuauuuaugagauguaucua

SEQ ID NO: 83 - RNA, 21 nt, Artificial Sequence
  source: /note="Description of Artificial Sequence: Synthetic oligonucleotide"
aggggcaaaaacgaaagcgca

SEQ ID NO: 84 - RNA, 21 nt, Artificial Sequence
  source: /note="Description of Artificial Sequence: Synthetic oligonucleotide"
uugcucucuuauuuguaccga

SEQ ID NO: 85 - RNA, 21 nt, Artificial Sequence
  source: /note="Description of Artificial Sequence: Synthetic oligonucleotide"
auuuguuuguacaagauccga

SEQ ID NO: 86 - RNA, 21 nt, Artificial Sequence
  source: /note="Description of Artificial Sequence: Synthetic oligonucleotide"
uugcagaugugacaagccgaa

SEQ ID NO: 87 - RNA, 21 nt, Artificial Sequence
  source: /note="Description of Artificial Sequence: Synthetic oligonucleotide"
caacuauuuaugagauguaua

SEQ ID NO: 88 - RNA, 21 nt, Artificial Sequence
  source: /note="Description of Artificial Sequence: Synthetic oligonucleotide"
aauucuacauacuaaaucuca

SEQ ID NO: 89 - RNA, 21 nt, Artificial Sequence
  source: /note="Description of Artificial Sequence: Synthetic oligonucleotide"
auguccucacaccauugaaaa

SEQ ID NO: 90 - RNA, 21 nt, Artificial Sequence
  source: /note="Description of Artificial Sequence: Synthetic oligonucleotide"
uuguuuguacaagauccgcaa

SEQ ID NO: 91 - RNA, 21 nt, Artificial Sequence
  source: /note="Description of Artificial Sequence: Synthetic oligonucleotide"
uaauccagaaaccugaaauga

SEQ ID NO: 92 - RNA, 21 nt, Artificial Sequence
  source: /note="Description of Artificial Sequence: Synthetic oligonucleotide"
gaaaaaaaaucaguucgagga

SEQ ID NO: 93 - RNA, 21 nt, Artificial Sequence
  source: /note="Description of Artificial Sequence: Synthetic oligonucleotide"
gggcaaaaacgaaagcgcaaa

SEQ ID NO: 94 - RNA, 21 nt, Artificial Sequence
  source: /note="Description of Artificial Sequence: Synthetic oligonucleotide"
ugaaguucauggaugucuaua

SEQ ID NO: 95 - RNA, 21 nt, Artificial Sequence
  source: /note="Description of Artificial Sequence: Synthetic oligonucleotide"
cacgaaguggugaaguucaua

SEQ ID NO: 96 - RNA, 21 nt, Artificial Sequence
  source: /note="Description of Artificial Sequence: Synthetic oligonucleotide"
acgucuuugucucuagugcaa

SEQ ID NO: 97 - RNA, 21 nt, Artificial Sequence
  source: /note="Description of Artificial Sequence: Synthetic oligonucleotide"
aacaucaccaugcagauuaua

SEQ ID NO: 98 - RNA, 21 nt, Artificial Sequence
  source: /note="Description of Artificial Sequence: Synthetic oligonucleotide"
ggugcuacuguuuauccguaa

SEQ ID NO: 99 - RNA, 21 nt, Artificial Sequence
  source: /note="Description of Artificial Sequence: Synthetic oligonucleotide"
aaauagacauugcuauucuga

SEQ ID NO: 100 - RNA, 21 nt, Artificial Sequence
  source: /note="Description of Artificial Sequence: Synthetic oligonucleotide"
uuccccaaaucacuguggaua

SEQ ID NO: 101 - RNA, 21 nt, Artificial Sequence
  source: /note="Description of Artificial Sequence: Synthetic oligonucleotide"
gauccgcagacguguaaauga

SEQ ID NO: 102 - RNA, 21 nt, Artificial Sequence
  source: /note="Description of Artificial Sequence: Synthetic oligonucleotide"
uuaacaucacgucuuugucua

SEQ ID NO: 103 - RNA, 21 nt, Artificial Sequence
  source: /note="Description of Artificial Sequence: Synthetic oligonucleotide"
aaagugagugaccugcuuuua

SEQ ID NO: 104 - RNA, 21 nt, Artificial Sequence
  source: /note="Description of Artificial Sequence: Synthetic oligonucleotide"
aaaaacacagacucgcguuga

SEQ ID NO: 105 - RNA, 21 nt, Artificial Sequence
  source: /note="Description of Artificial Sequence: Synthetic oligonucleotide"
cgucgcacugaaacuuuucga

SEQ ID NO: 106 - RNA, 21 nt, Artificial Sequence
  source: /note="Description of Artificial Sequence: Synthetic oligonucleotide"
aacagugcuaauguuauugga

SEQ ID NO: 107 - RNA, 21 nt, Artificial Sequence
  source: /note="Description of Artificial Sequence: Synthetic oligonucleotide"
uucguccaacuucugggcuga

SEQ ID NO: 108 - RNA, 21 nt, Artificial Sequence
  source: /note="Description of Artificial Sequence: Synthetic oligonucleotide"
auuggugucuucacuggauga

SEQ ID NO: 109 - RNA, 21 nt, Artificial Sequence
  source: /note="Description of Artificial Sequence: Synthetic oligonucleotide"
gcaaaaacacagacucgcgua

SEQ ID NO: 110 - RNA, 21 nt, Artificial Sequence
  source: /note="Description of Artificial Sequence: Synthetic oligonucleotide"
aaaaaucaguucgaggaaaga

SEQ ID NO: 111 - RNA, 21 nt, Artificial Sequence
  source: /note="Description of Artificial Sequence: Synthetic oligonucleotide"
cagacguguaaauguuccuga

SEQ ID NO: 112 - RNA, 21 nt, Artificial Sequence
  source: /note="Description of Artificial Sequence: Synthetic oligonucleotide"
uguccucacaccauugaaaca

SEQ ID NO: 113 - RNA, 21 nt, Artificial Sequence
  source: /note="Description of Artificial Sequence: Synthetic oligonucleotide"
uuuuuuucaguauucuuggua

SEQ ID NO: 114 - RNA, 21 nt, Artificial Sequence
  source: /note="Description of Artificial Sequence: Synthetic oligonucleotide"
agauccgcagacguguaaaua

SEQ ID NO: 115 - RNA, 21 nt, Artificial Sequence
  source: /note="Description of Artificial Sequence: Synthetic oligonucleotide"
cccucuuggaauuggauucga

SEQ ID NO: 116 - RNA, 21 nt, Artificial Sequence
  source: /note="Description of Artificial Sequence: Synthetic oligonucleotide"
gauauuaacaucacgucuuua

SEQ ID NO: 117 - RNA, 21 nt, Artificial Sequence
  source: /note="Description of Artificial Sequence: Synthetic oligonucleotide"
uuggugcuacuguuuauccga

SEQ ID NO: 118 - RNA, 21 nt, Artificial Sequence
  source: /note="Description of Artificial Sequence: Synthetic oligonucleotide"
aaggggcaaaaacgaaagcga

SEQ ID NO: 119 - RNA, 21 nt, Artificial Sequence
  source: /note="Description of Artificial Sequence: Synthetic oligonucleotide"
cuugcagaugugacaagccga

SEQ ID NO: 120 - RNA, 21 nt, Artificial Sequence
  source: /note="Description of Artificial Sequence: Synthetic oligonucleotide"
aaaucaguucgaggaaaggga

SEQ ID NO: 121 - RNA, 21 nt, Artificial Sequence
  source: /note="Description of Artificial Sequence: Synthetic oligonucleotide"
acuuuucguccaacuucugga

SEQ ID NO: 122 - RNA, 21 nt, Artificial Sequence
  source: /note="Description of Artificial Sequence: Synthetic oligonucleotide"
auuaacaucacgucuuuguca

SEQ ID NO: 123 - RNA, 21 nt, Artificial Sequence
  source: /note="Description of Artificial Sequence: Synthetic oligonucleotide"
cgucuuugucucuagugcaga

SEQ ID NO: 124 - RNA, 21 nt, Artificial Sequence
  source: /note="Description of Artificial Sequence: Synthetic oligonucleotide"
aacacagacucgcguugcaaa

SEQ ID NO: 125 - RNA, 21 nt, Artificial Sequence
  source: /note="Description of Artificial Sequence: Synthetic oligonucleotide"
auauuaacaucacgucuuuga

SEQ ID NO: 126 - RNA, 21 nt, Artificial Sequence
  source: /note="Description of Artificial Sequence: Synthetic oligonucleotide"
guuuauccguaauaauuguga

SEQ ID NO: 127 - RNA, 21 nt, Artificial Sequence
  source: /note="Description of Artificial Sequence: Synthetic oligonucleotide"
aaaaucaguucgaggaaagga

SEQ ID NO: 128 - RNA, 21 nt, Artificial Sequence
  source: /note="Description of Artificial Sequence: Synthetic oligonucleotide"
uuuauccguaauaauugugga

SEQ ID NO: 129 - RNA, 21 nt, Artificial Sequence
  source: /note="Description of Artificial Sequence: Synthetic oligonucleotide"
aggacauugcugugcuuugga

SEQ ID NO: 130 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaucgtucuguaucagucuuuc

SEQ ID NO: 131 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggauatuaaauaaguaccguau

SEQ ID NO: 132 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuggatuaaggacuguucuguc

SEQ ID NO: 133 - RNA, 23 nt, Artificial Sequence
  source: /note="Description of Artificial Sequence: Synthetic oligonucleotide"
ugauuaaggacuguucugucgau

SEQ ID NO: 134 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaucutguacaaacaaaugcuu

SEQ ID NO: 135 - RNA, 23 nt, Artificial Sequence
  source: /note="Description of Artificial Sequence: Synthetic oligonucleotide"
uauccagugaagacaccaauaac

SEQ ID NO: 136 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucgatcguucuguaucagucu

SEQ ID NO: 137 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucgutcuguaucagucuuucc

SEQ ID NO: 138 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuguatcgaucguucuguauca

SEQ ID NO: 139 - RNA, 23 nt, Artificial Sequence
  source: /note="Description of Artificial Sequence: Synthetic oligonucleotide"
uuaucgaucguucuguaucaguc

SEQ ID NO: 140 - RNA, 23 nt, Artificial Sequence
  source: /note="Description of Artificial Sequence: Synthetic oligonucleotide"
ucguauauaaaacacuuucucuu

SEQ ID NO: 141 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacauctgcaaguacguucguuu

SEQ ID NO: 142 - RNA, 23 nt, Artificial Sequence
  source: /note="Description of Artificial Sequence: Synthetic oligonucleotide"
uauggcgaauccaauuccaagag

SEQ ID NO: 143 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuucgutuaacucaagcugccuc

SEQ ID NO: 144 - RNA, 23 nt, Artificial Sequence
  source: /note="Description of Artificial Sequence: Synthetic oligonucleotide"
uacuucgugaugauucugcccuc

SEQ ID NO: 145 - RNA, 23 nt, Artificial Sequence
  source: /note="Description of Artificial Sequence: Synthetic oligonucleotide"
ucugcaaguacguucguuuaacu

SEQ ID NO: 146 - RNA, 23 nt, Artificial Sequence
  source: /note="Description of Artificial Sequence: Synthetic oligonucleotide"
uccagugaagacaccaauaacau

SEQ ID NO: 147 - RNA, 23 nt, Artificial Sequence
  source: /note="Description of Artificial Sequence: Synthetic oligonucleotide"
uacguucguuuaacucaagcugc

SEQ ID NO: 148 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguucgtuuaacucaagcugccu

SEQ ID NO: 149 - RNA, 23 nt, Artificial Sequence
  source: /note="Description of Artificial Sequence: Synthetic oligonucleotide"
uccaugaacuucaccacuucgug

SEQ ID NO: 150 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaccactucgugaugauucugcc

SEQ ID NO: 151 - RNA, 23 nt, Artificial Sequence
  source: /note="Description of Artificial Sequence: Synthetic oligonucleotide"
uagaauagcaaugucuauuuuau

SEQ ID NO: 152 - RNA, 23 nt, Artificial Sequence
  source: /note="Description of Artificial Sequence: Synthetic oligonucleotide"
ucguucguuuaacucaagcugcc

SEQ ID NO: 153 - RNA, 23 nt, Artificial Sequence
  source: /note="Description of Artificial Sequence: Synthetic oligonucleotide"
uggacgaaaaguuucagugcgac

SEQ ID NO: 154 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagguutgauccgcauaaucugc

SEQ ID NO: 155 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaccggtacaaauaagagagcaa

SEQ ID NO: 156 - RNA, 23 nt, Artificial Sequence
  source: /note="Description of Artificial Sequence: Synthetic oligonucleotide"
uagauaagcuagugacugucacc

SEQ ID NO: 157 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguacgtucguuuaacucaagcu

SEQ ID NO: 158 - RNA, 23 nt, Artificial Sequence
  source: /note="Description of Artificial Sequence: Synthetic oligonucleotide"
uacaccaauaacauuagcacugu

SEQ ID NO: 159 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacauutacacgucugcggaucu

SEQ ID NO: 160 - RNA, 23 nt, Artificial Sequence
  source: /note="Description of Artificial Sequence: Synthetic oligonucleotide"
ucgaucguucuguaucagucuuu

SEQ ID NO: 161 - RNA, 23 nt, Artificial Sequence
  source: /note="Description of Artificial Sequence: Synthetic oligonucleotide"
ucagugaagacaccaauaacauu

SEQ ID NO: 162 - RNA, 23 nt, Artificial Sequence
  source: /note="Description of Artificial Sequence: Synthetic oligonucleotide"
uugaauaucaaauuccagcaccg

SEQ ID NO: 163 - RNA, 23 nt, Artificial Sequence
  source: /note="Description of Artificial Sequence: Synthetic oligonucleotide"
ugcucggugauuuagcagcaaga

SEQ ID NO: 164 - RNA, 23 nt, Artificial Sequence
  source: /note="Description of Artificial Sequence: Synthetic oligonucleotide"
uuccgcauaaucugcauggugau

SEQ ID NO: 165 - RNA, 23 nt, Artificial Sequence
  source: /note="Description of Artificial Sequence: Synthetic oligonucleotide"
uuuguacaaacaaaugcuuucuc

SEQ ID NO: 166 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuacgutcguuuaacucaagcug

SEQ ID NO: 167 - RNA, 23 nt, Artificial Sequence
  source: /note="Description of Artificial Sequence: Synthetic oligonucleotide"
uaagcuagugacugucaccgauc

SEQ ID NO: 168 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucguutaacucaagcugccucg

SEQ ID NO: 169 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcgagtcuguguuuuugcagga

SEQ ID NO: 170 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucucggtgauuuagcagcaagaa

SEQ ID NO: 171 - RNA, 23 nt, Artificial Sequence
  source: /note="Description of Artificial Sequence: Synthetic oligonucleotide"
ucggugauuuagcagcaagaaaa

SEQ ID NO: 172 - RNA, 23 nt, Artificial Sequence
  source: /note="Description of Artificial Sequence: Synthetic oligonucleotide"
ucuuguacaaacaaaugcuuucu

SEQ ID NO: 173 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacautuacacgucugcggauc

SEQ ID NO: 174 - RNA, 23 nt, Artificial Sequence
  source: /note="Description of Artificial Sequence: Synthetic oligonucleotide"
ugggauauuaaauaaguaccgua

SEQ ID NO: 175 - RNA, 23 nt, Artificial Sequence
  source: /note="Description of Artificial Sequence: Synthetic oligonucleotide"
uucgaucguucuguaucagucuu

SEQ ID NO: 176 - RNA, 23 nt, Artificial Sequence
  source: /note="Description of Artificial Sequence: Synthetic oligonucleotide"
ugcaacgcgagucuguguuuuug

SEQ ID NO: 177 - RNA, 23 nt, Artificial Sequence
  source: /note="Description of Artificial Sequence: Synthetic oligonucleotide"
ucaaguacguucguuuaacucaa

SEQ ID NO: 178 - RNA, 23 nt, Artificial Sequence
  source: /note="Description of Artificial Sequence: Synthetic oligonucleotide"
ucagucaaauacauccagugaag

SEQ ID NO: 179 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaagutcaugguuucggaggcc

SEQ ID NO: 180 - RNA, 23 nt, Artificial Sequence
  source: /note="Description of Artificial Sequence: Synthetic oligonucleotide"
uaguacguucguuuaacucaagc

SEQ ID NO: 181 - RNA, 23 nt, Artificial Sequence
  source: /note="Description of Artificial Sequence: Synthetic oligonucleotide"
uauuacggauaaacaguagcacc

SEQ ID NO: 182 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaacatuuacacgucugcggau

SEQ ID NO: 183 - RNA, 23 nt, Artificial Sequence
  source: /note="Description of Artificial Sequence: Synthetic oligonucleotide"
uggaacauuuacacgucugcgga

SEQ ID NO: 184 - RNA, 23 nt, Artificial Sequence
  source: /note="Description of Artificial Sequence: Synthetic oligonucleotide"
ucaacaaugugucucuucucuuc

SEQ ID NO: 185 - RNA, 23 nt, Artificial Sequence
  source: /note="Description of Artificial Sequence: Synthetic oligonucleotide"
uauucacauuuguugugcuguag

SEQ ID NO: 186 - RNA, 23 nt, Artificial Sequence
  source: /note="Description of Artificial Sequence: Synthetic oligonucleotide"
uucggugauuuagcagcaagaaa

SEQ ID NO: 187 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuagtgguuucaaugguguga

SEQ ID NO: 188 - RNA, 23 nt, Artificial Sequence
  source: /note="Description of Artificial Sequence: Synthetic oligonucleotide"
ucguuuaacucaagcugccucgc

SEQ ID NO: 189 - RNA, 23 nt, Artificial Sequence
  source: /note="Description of Artificial Sequence: Synthetic oligonucleotide"
uuggacgaaaaguuucagugcga

SEQ ID NO: 190 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauaagtaccguauauaaaacac

SEQ ID NO: 191 - RNA, 23 nt, Artificial Sequence
  source: /note="Description of Artificial Sequence: Synthetic oligonucleotide"
uaacuagugguuucaauggugug

SEQ ID NO: 192 - RNA, 23 nt, Artificial Sequence
  source: /note="Description of Artificial Sequence: Synthetic oligonucleotide"
ucgcauaaucugcauggugaugu

SEQ ID NO: 193 - RNA, 23 nt, Artificial Sequence
  source: /note="Description of Artificial Sequence: Synthetic oligonucleotide"
uaaguacguucguuuaacucaag

SEQ ID NO: 194 - RNA, 23 nt, Artificial Sequence
  source: /note="Description of Artificial Sequence: Synthetic oligonucleotide"
uaccguauauaaaacacuuucuc

SEQ ID NO: 195 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaagataagcuagugacuguca

SEQ ID NO: 196 - RNA, 23 nt, Artificial Sequence
  source: /note="Description of Artificial Sequence: Synthetic oligonucleotide"
uuuacggauaaacaguagcacca

SEQ ID NO: 197 - RNA, 23 nt, Artificial Sequence
  source: /note="Description of Artificial Sequence: Synthetic oligonucleotide"
ucgagucuguguuuuugcaggaa

SEQ ID NO: 198 - RNA, 23 nt, Artificial Sequence
  source: /note="Description of Artificial Sequence: Synthetic oligonucleotide"
uaacgcgagucuguguuuuugca

SEQ ID NO: 199 - RNA, 23 nt, Artificial Sequence
  source: /note="Description of Artificial Sequence: Synthetic oligonucleotide"
ucccaacucaaguccacagcagu

SEQ ID NO: 200 - RNA, 23 nt, Artificial Sequence
  source: /note="Description of Artificial Sequence: Synthetic oligonucleotide"
ugacaccaauaacauuagcacug

SEQ ID NO: 201 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggataaacaguagcaccaau

SEQ ID NO: 202 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccguatauaaaacacuuucucu

SEQ ID NO: 203 - RNA, 23 nt, Artificial Sequence
  source: /note="Description of Artificial Sequence: Synthetic oligonucleotide"
ugauacaucucauaaauaguuga

SEQ ID NO: 204 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaagtacguucguuuaacuca

SEQ ID NO: 205 - RNA, 23 nt, Artificial Sequence
  source: /note="Description of Artificial Sequence: Synthetic oligonucleotide"
ucacaggauggcuugaagaugua

SEQ ID NO: 206 - RNA, 23 nt, Artificial Sequence
  source: /note="Description of Artificial Sequence: Synthetic oligonucleotide"
uccaagaauacugaaaaaaaacc

SEQ ID NO: 207 - RNA, 23 nt, Artificial Sequence
  source: /note="Description of Artificial Sequence: Synthetic oligonucleotide"
ucccacaauuauuacggauaaac

SEQ ID NO: 208 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagggatauuaaauaaguaccgu

SEQ ID NO: 209 - RNA, 23 nt, Artificial Sequence
  source: /note="Description of Artificial Sequence: Synthetic oligonucleotide"
ugcacuagagacaaagacgugau

SEQ ID NO: 210 - RNA, 23 nt, Artificial Sequence
  source: /note="Description of Artificial Sequence: Synthetic oligonucleotide"
ucgcgagucuguguuuuugcagg

SEQ ID NO: 211 - RNA, 23 nt, Artificial Sequence
  source: /note="Description of Artificial Sequence: Synthetic oligonucleotide"
uagauacaucucauaaauaguug

SEQ ID NO: 212 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcgcutucguuuuugccccuuu

SEQ ID NO: 213 - RNA, 23 nt, Artificial Sequence
  source: /note="Description of Artificial Sequence: Synthetic oligonucleotide"
ucgguacaaauaagagagcaaga

SEQ ID NO: 214 - RNA, 23 nt, Artificial Sequence
  source: /note="Description of Artificial Sequence: Synthetic oligonucleotide"
ucggaucuuguacaaacaaaugc

SEQ ID NO: 215 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucggctugucacaucugcaagu

SEQ ID NO: 216 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauacatcucauaaauaguugaa

SEQ ID NO: 217 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagautuaguauguagaauucu

SEQ ID NO: 218 - RNA, 23 nt, Artificial Sequence
  source: /note="Description of Artificial Sequence: Synthetic oligonucleotide"
uuuucaauggugugaggacauag

SEQ ID NO: 219 - RNA, 23 nt, Artificial Sequence
  source: /note="Description of Artificial Sequence: Synthetic oligonucleotide"
uugcggaucuuguacaaacaaau

SEQ ID NO: 220 - RNA, 23 nt, Artificial Sequence
  source: /note="Description of Artificial Sequence: Synthetic oligonucleotide"
ucauuucagguuucuggauuaag

SEQ ID NO: 221 - RNA, 23 nt, Artificial Sequence
  source: /note="Description of Artificial Sequence: Synthetic oligonucleotide"
uccucgaacugauuuuuuuucuu

SEQ ID NO: 222 - RNA, 23 nt, Artificial Sequence
  source: /note="Description of Artificial Sequence: Synthetic oligonucleotide"
uuugcgcuuucguuuuugccccu

SEQ ID NO: 223 - RNA, 23 nt, Artificial Sequence
  source: /note="Description of Artificial Sequence: Synthetic oligonucleotide"
uauagacauccaugaacuucacc

SEQ ID NO: 224 - RNA, 23 nt, Artificial Sequence
  source: /note="Description of Artificial Sequence: Synthetic oligonucleotide"
uaugaacuucaccacuucgugau

SEQ ID NO: 225 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugcactagagacaaagacguga

SEQ ID NO: 226 - RNA, 23 nt, Artificial Sequence
  source: /note="Description of Artificial Sequence: Synthetic oligonucleotide"
uauaaucugcauggugauguugg

SEQ ID NO: 227 - RNA, 23 nt, Artificial Sequence
  source: /note="Description of Artificial Sequence: Synthetic oligonucleotide"
uuacggauaaacaguagcaccaa

SEQ ID NO: 228 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagaatagcaaugucuauuuua

SEQ ID NO: 229 - RNA, 23 nt, Artificial Sequence
  source: /note="Description of Artificial Sequence: Synthetic oligonucleotide"
uauccacagugauuuggggaagu

SEQ ID NO: 230 - RNA, 23 nt, Artificial Sequence
  source: /note="Description of Artificial Sequence: Synthetic oligonucleotide"
ucauuuacacgucugcggaucuu

SEQ ID NO: 231 - RNA, 23 nt, Artificial Sequence
  source: /note="Description of Artificial Sequence: Synthetic oligonucleotide"
uagacaaagacgugauguuaaua

SEQ ID NO: 232 - RNA, 23 nt, Artificial Sequence
  source: /note="Description of Artificial Sequence: Synthetic oligonucleotide"
uaaaagcaggucacucacuuugc

SEQ ID NO: 233 - RNA, 23 nt, Artificial Sequence
  source: /note="Description of Artificial Sequence: Synthetic oligonucleotide"
ucaacgcgagucuguguuuuugc

SEQ ID NO: 234 - RNA, 23 nt, Artificial Sequence
  source: /note="Description of Artificial Sequence: Synthetic oligonucleotide"
ucgaaaaguuucagugcgacgcc

SEQ ID NO: 235 - RNA, 23 nt, Artificial Sequence
  source: /note="Description of Artificial Sequence: Synthetic oligonucleotide"
uccaauaacauuagcacuguuaa

SEQ ID NO: 236 - RNA, 23 nt, Artificial Sequence
  source: /note="Description of Artificial Sequence: Synthetic oligonucleotide"
ucagcccagaaguuggacgaaaa

SEQ ID NO: 237 - RNA, 23 nt, Artificial Sequence
  source: /note="Description of Artificial Sequence: Synthetic oligonucleotide"
ucauccagugaagacaccaauaa

SEQ ID NO: 238 - RNA, 23 nt, Artificial Sequence
  source: /note="Description of Artificial Sequence: Synthetic oligonucleotide"
uacgcgagucuguguuuuugcag

SEQ ID NO: 239 - RNA, 23 nt, Artificial Sequence
  source: /note="Description of Artificial Sequence: Synthetic oligonucleotide"
ucuuuccucgaacugauuuuuuu

SEQ ID NO: 240 - RNA, 23 nt, Artificial Sequence
  source: /note="Description of Artificial Sequence: Synthetic oligonucleotide"
ucaggaacauuuacacgucugcg

SEQ ID NO: 241 - RNA, 23 nt, Artificial Sequence
  source: /note="Description of Artificial Sequence: Synthetic oligonucleotide"
uguuucaauggugugaggacaua

SEQ ID NO: 242 - RNA, 23 nt, Artificial Sequence
  source: /note="Description of Artificial Sequence: Synthetic oligonucleotide"
uaccaagaauacugaaaaaaaac

SEQ ID NO: 243 - RNA, 23 nt, Artificial Sequence
  source: /note="Description of Artificial Sequence: Synthetic oligonucleotide"
uauuuacacgucugcggaucuug

SEQ ID NO: 244 - RNA, 23 nt, Artificial Sequence
  source: /note="Description of Artificial Sequence: Synthetic oligonucleotide"
ucgaauccaauuccaagagggac

SEQ ID NO: 245 - RNA, 23 nt, Artificial Sequence
  source: /note="Description of Artificial Sequence: Synthetic oligonucleotide"
uaaagacgugauguuaauaucuu

SEQ ID NO: 246 - RNA, 23 nt, Artificial Sequence
  source: /note="Description of Artificial Sequence: Synthetic oligonucleotide"
ucggauaaacaguagcaccaaua

SEQ ID NO: 247 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgcuutcguuuuugccccuuuc

SEQ ID NO: 248 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggcutgucacaucugcaagua

SEQ ID NO: 249 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucccuutccucgaacugauuuuu

SEQ ID NO: 250 - RNA, 23 nt, Artificial Sequence
  source: /note="Description of Artificial Sequence: Synthetic oligonucleotide"
uccagaaguuggacgaaaaguuu

SEQ ID NO: 251 - RNA, 23 nt, Artificial Sequence
  source: /note="Description of Artificial Sequence: Synthetic oligonucleotide"
ugacaaagacgugauguuaauau

SEQ ID NO: 252 - RNA, 23 nt, Artificial Sequence
  source: /note="Description of Artificial Sequence: Synthetic oligonucleotide"
ucugcacuagagacaaagacgug

SEQ ID NO: 253 - RNA, 23 nt, Artificial Sequence
  source: /note="Description of Artificial Sequence: Synthetic oligonucleotide"
uuugcaacgcgagucuguguuuu

SEQ ID NO: 254 - RNA, 23 nt, Artificial Sequence
  source: /note="Description of Artificial Sequence: Synthetic oligonucleotide"
ucaaagacgugauguuaauaucu

SEQ ID NO: 255 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacaatuauuacggauaaacag

SEQ ID NO: 256 - RNA, 23 nt, Artificial Sequence
  source: /note="Description of Artificial Sequence: Synthetic oligonucleotide"
uccuuuccucgaacugauuuuuu

SEQ ID NO: 257 - RNA, 23 nt, Artificial Sequence
  source: /note="Description of Artificial Sequence: Synthetic oligonucleotide"
uccacaauuauuacggauaaaca

SEQ ID NO: 258 - RNA, 23 nt, Artificial Sequence
  source: /note="Description of Artificial Sequence: Synthetic oligonucleotide"
uccaaagcacagcaauguccuga

SEQ ID NO: 259 - RNA, 21 nt, Artificial Sequence
  source: /note="Description of Artificial Sequence: Synthetic oligonucleotide"
aagacugauacagaacgauca

SEQ ID NO: 260 - RNA, 21 nt, Artificial Sequence
  source: /note="Description of Artificial Sequence: Synthetic oligonucleotide"
acgguacuuauuuaauaucca

SEQ ID NO: 261 - RNA, 21 nt, Artificial Sequence
  source: /note="Description of Artificial Sequence: Synthetic oligonucleotide"
cagaacaguccuuaauccaga

SEQ ID NO: 262 - RNA, 21 nt, Artificial Sequence
  source: /note="Description of Artificial Sequence: Synthetic oligonucleotide"
cgacagaacaguccuuaauca

SEQ ID NO: 263 - RNA, 21 nt, Artificial Sequence
  source: /note="Description of Artificial Sequence: Synthetic oligonucleotide"
gcauuuguuuguacaagauca

SEQ ID NO: 264 - RNA, 21 nt, Artificial Sequence
  source: /note="Description of Artificial Sequence: Synthetic oligonucleotide"
uauuggugucuucacuggaua

SEQ ID NO: 265 - RNA, 21 nt, Artificial Sequence
  source: /note="Description of Artificial Sequence: Synthetic oligonucleotide"
acugauacagaacgaucgaua

SEQ ID NO: 266 - RNA, 21 nt, Artificial Sequence
  source: /note="Description of Artificial Sequence: Synthetic oligonucleotide"
aaagacugauacagaacgaua

SEQ ID NO: 267 - RNA, 21 nt, Artificial Sequence
  source: /note="Description of Artificial Sequence: Synthetic oligonucleotide"
auacagaacgaucgauacaga

SEQ ID NO: 268 - RNA, 21 nt, Artificial Sequence
  source: /note="Description of Artificial Sequence: Synthetic oligonucleotide"
cugauacagaacgaucgauaa

SEQ ID NO: 269 - RNA, 21 nt, Artificial Sequence
  source: /note="Description of Artificial Sequence: Synthetic oligonucleotide"
gagaaaguguuuuauauacga

SEQ ID NO: 270 - RNA, 21 nt, Artificial Sequence
  source: /note="Description of Artificial Sequence: Synthetic oligonucleotide"
acgaacguacuugcagaugua

SEQ ID NO: 271 - RNA, 21 nt, Artificial Sequence
  source: /note="Description of Artificial Sequence: Synthetic oligonucleotide"
cuuggaauuggauucgccaua

SEQ ID NO: 272 - RNA, 21 nt, Artificial Sequence
  source: /note="Description of Artificial Sequence: Synthetic oligonucleotide"
ggcagcuugaguuaaacgaaa

SEQ ID NO: 273 - RNA, 21 nt, Artificial Sequence
  source: /note="Description of Artificial Sequence: Synthetic oligonucleotide"
gggcagaaucaucacgaagua

SEQ ID NO: 274 - RNA, 21 nt, Artificial Sequence
  source: /note="Description of Artificial Sequence: Synthetic oligonucleotide"
uuaaacgaacguacuugcaga

SEQ ID NO: 275 - RNA, 21 nt, Artificial Sequence
  source: /note="Description of Artificial Sequence: Synthetic oligonucleotide"
guuauuggugucuucacugga

SEQ ID NO: 276 - RNA, 21 nt, Artificial Sequence
  source: /note="Description of Artificial Sequence: Synthetic oligonucleotide"
agcuugaguuaaacgaacgua

SEQ ID NO: 277 - RNA, 21 nt, Artificial Sequence
  source: /note="Description of Artificial Sequence: Synthetic oligonucleotide"
gcagcuugaguuaaacgaaca

SEQ ID NO: 278 - RNA, 21 nt, Artificial Sequence
  source: /note="Description of Artificial Sequence: Synthetic oligonucleotide"
cgaaguggugaaguucaugga

SEQ ID NO: 279 - RNA, 21 nt, Artificial Sequence
  source: /note="Description of Artificial Sequence: Synthetic oligonucleotide"
cagaaucaucacgaaguggua

SEQ ID NO: 280 - RNA, 21 nt, Artificial Sequence
  source: /note="Description of Artificial Sequence: Synthetic oligonucleotide"
aaaauagacauugcuauucua

SEQ ID NO: 281 - RNA, 21 nt, Artificial Sequence
  source: /note="Description of Artificial Sequence: Synthetic oligonucleotide"
cagcuugaguuaaacgaacga

SEQ ID NO: 282 - RNA, 21 nt, Artificial Sequence
  source: /note="Description of Artificial Sequence: Synthetic oligonucleotide"
cgcacugaaacuuuucgucca

SEQ ID NO: 283 - RNA, 21 nt, Artificial Sequence
  source: /note="Description of Artificial Sequence: Synthetic oligonucleotide"
agauuaugcggaucaaaccua

SEQ ID NO: 284 - RNA, 21 nt, Artificial Sequence
  source: /note="Description of Artificial Sequence: Synthetic oligonucleotide"
gcucucuuauuuguaccggua

SEQ ID NO: 285 - RNA, 21 nt, Artificial Sequence
  source: /note="Description of Artificial Sequence: Synthetic oligonucleotide"
ugacagucacuagcuuaucua

SEQ ID NO: 286 - RNA, 21 nt, Artificial Sequence
  source: /note="Description of Artificial Sequence: Synthetic oligonucleotide"
cuugaguuaaacgaacguaca

SEQ ID NO: 287 - RNA, 21 nt, Artificial Sequence
  source: /note="Description of Artificial Sequence: Synthetic oligonucleotide"
agugcuaauguuauuggugua

SEQ ID NO: 288 - RNA, 21 nt, Artificial Sequence
  source: /note="Description of Artificial Sequence: Synthetic oligonucleotide"
auccgcagacguguaaaugua

SEQ ID NO: 289 - RNA, 21 nt, Artificial Sequence
  source: /note="Description of Artificial Sequence: Synthetic oligonucleotide"
agacugauacagaacgaucga

SEQ ID NO: 290 - RNA, 21 nt, Artificial Sequence
  source: /note="Description of Artificial Sequence: Synthetic oligonucleotide"
uguuauuggugucuucacuga

SEQ ID NO: 291 - RNA, 21 nt, Artificial Sequence
  source: /note="Description of Artificial Sequence: Synthetic oligonucleotide"
gugcuggaauuugauauucaa

SEQ ID NO: 292 - RNA, 21 nt, Artificial Sequence
  source: /note="Description of Artificial Sequence: Synthetic oligonucleotide"
uugcugcuaaaucaccgagca

SEQ ID NO: 293 - RNA, 21 nt, Artificial Sequence
  source: /note="Description of Artificial Sequence: Synthetic oligonucleotide"
caccaugcagauuaugcggaa

SEQ ID NO: 294 - RNA, 21 nt, Artificial Sequence
  source: /note="Description of Artificial Sequence: Synthetic oligonucleotide"
gaaagcauuuguuuguacaaa

SEQ ID NO: 295 - RNA, 21 nt, Artificial Sequence
  source: /note="Description of Artificial Sequence: Synthetic oligonucleotide"
gcuugaguuaaacgaacguaa

SEQ ID NO: 296 - RNA, 21 nt, Artificial Sequence
  source: /note="Description of Artificial Sequence: Synthetic oligonucleotide"
ucggugacagucacuagcuua

SEQ ID NO: 297 - RNA, 21 nt, Artificial Sequence
  source: /note="Description of Artificial Sequence: Synthetic oligonucleotide"
aggcagcuugaguuaaacgaa

SEQ ID NO: 298 - RNA, 21 nt, Artificial Sequence
  source: /note="Description of Artificial Sequence: Synthetic oligonucleotide"
cugcaaaaacacagacucgca

SEQ ID NO: 299 - RNA, 21 nt, Artificial Sequence
  source: /note="Description of Artificial Sequence: Synthetic oligonucleotide"
cuugcugcuaaaucaccgaga

SEQ ID NO: 300 - RNA, 21 nt, Artificial Sequence
  source: /note="Description of Artificial Sequence: Synthetic oligonucleotide"
uucuugcugcuaaaucaccga

SEQ ID NO: 301 - RNA, 21 nt, Artificial Sequence
  source: /note="Description of Artificial Sequence: Synthetic oligonucleotide"
aaagcauuuguuuguacaaga

SEQ ID NO: 302 - RNA, 21 nt, Artificial Sequence
  source: /note="Description of Artificial Sequence: Synthetic oligonucleotide"
uccgcagacguguaaauguua

SEQ ID NO: 303 - RNA, 21 nt, Artificial Sequence
  source: /note="Description of Artificial Sequence: Synthetic oligonucleotide"
cgguacuuauuuaauauccca

SEQ ID NO: 304 - RNA, 21 nt, Artificial Sequence
  source: /note="Description of Artificial Sequence: Synthetic oligonucleotide"
gacugauacagaacgaucgaa

SEQ ID NO: 305 - RNA, 21 nt, Artificial Sequence
  source: /note="Description of Artificial Sequence: Synthetic oligonucleotide"
aaaacacagacucgcguugca

SEQ ID NO: 306 - RNA, 21 nt, Artificial Sequence
  source: /note="Description of Artificial Sequence: Synthetic oligonucleotide"
gaguuaaacgaacguacuuga

SEQ ID NO: 307 - RNA, 21 nt, Artificial Sequence
  source: /note="Description of Artificial Sequence: Synthetic oligonucleotide"
ucacuggauguauuugacuga

SEQ ID NO: 308 - RNA, 21 nt, Artificial Sequence
  source: /note="Description of Artificial Sequence: Synthetic oligonucleotide"
ccuccgaaaccaugaacuuua

SEQ ID NO: 309 - RNA, 21 nt, Artificial Sequence
  source: /note="Description of Artificial Sequence: Synthetic oligonucleotide"
uugaguuaaacgaacguacua

SEQ ID NO: 310 - RNA, 21 nt, Artificial Sequence
  source: /note="Description of Artificial Sequence: Synthetic oligonucleotide"
ugcuacuguuuauccguaaua

SEQ ID NO: 311 - RNA, 21 nt, Artificial Sequence
  source: /note="Description of Artificial Sequence: Synthetic oligonucleotide"
ccgcagacguguaaauguuca

SEQ ID NO: 312 - RNA, 21 nt, Artificial Sequence
  source: /note="Description of Artificial Sequence: Synthetic oligonucleotide"
cgcagacguguaaauguucca

SEQ ID NO: 313 - RNA, 21 nt, Artificial Sequence
  source: /note="Description of Artificial Sequence: Synthetic oligonucleotide"
agagaagagacacauuguuga

SEQ ID NO: 314 - RNA, 21 nt, Artificial Sequence
  source: /note="Description of Artificial Sequence: Synthetic oligonucleotide"
acagcacaacaaaugugaaua

SEQ ID NO: 315 - RNA, 21 nt, Artificial Sequence
  source: /note="Description of Artificial Sequence: Synthetic oligonucleotide"
ucuugcugcuaaaucaccgaa

SEQ ID NO: 316 - RNA, 21 nt, Artificial Sequence
  source: /note="Description of Artificial Sequence: Synthetic oligonucleotide"
acaccauugaaaccacuagua

SEQ ID NO: 317 - RNA, 21 nt, Artificial Sequence
  source: /note="Description of Artificial Sequence: Synthetic oligonucleotide"
gaggcagcuugaguuaaacga

SEQ ID NO: 318 - RNA, 21 nt, Artificial Sequence
  source: /note="Description of Artificial Sequence: Synthetic oligonucleotide"
gcacugaaacuuuucguccaa

SEQ ID NO: 319 - RNA, 21 nt, Artificial Sequence
  source: /note="Description of Artificial Sequence: Synthetic oligonucleotide"
guuuuauauacgguacuuaua

SEQ ID NO: 320 - RNA, 21 nt, Artificial Sequence
  source: /note="Description of Artificial Sequence: Synthetic oligonucleotide"
caccauugaaaccacuaguua

SEQ ID NO: 321 - RNA, 21 nt, Artificial Sequence
  source: /note="Description of Artificial Sequence: Synthetic oligonucleotide"
aucaccaugcagauuaugcga

SEQ ID NO: 322 - RNA, 21 nt, Artificial Sequence
  source: /note="Description of Artificial Sequence: Synthetic oligonucleotide"
ugaguuaaacgaacguacuua

SEQ ID NO: 323 - RNA, 21 nt, Artificial Sequence
  source: /note="Description of Artificial Sequence: Synthetic oligonucleotide"
gaaaguguuuuauauacggua

SEQ ID NO: 324 - RNA, 21 nt, Artificial Sequence
  source: /note="Description of Artificial Sequence: Synthetic oligonucleotide"
acagucacuagcuuaucuuga

SEQ ID NO: 325 - RNA, 21 nt, Artificial Sequence
  source: /note="Description of Artificial Sequence: Synthetic oligonucleotide"
gugcuacuguuuauccguaaa

SEQ ID NO: 326 - RNA, 21 nt, Artificial Sequence
  source: /note="Description of Artificial Sequence: Synthetic oligonucleotide"
ccugcaaaaacacagacucga

SEQ ID NO: 327 - RNA, 21 nt, Artificial Sequence
  source: /note="Description of Artificial Sequence: Synthetic oligonucleotide"
caaaaacacagacucgcguua

SEQ ID NO: 328 - RNA, 21 nt, Artificial Sequence
  source: /note="Description of Artificial Sequence: Synthetic oligonucleotide"
ugcuguggacuugaguuggga

SEQ ID NO: 329 - RNA, 21 nt, Artificial Sequence
  source: /note="Description of Artificial Sequence: Synthetic oligonucleotide"
gugcuaauguuauugguguca

SEQ ID NO: 330 - RNA, 21 nt, Artificial Sequence
  source: /note="Description of Artificial Sequence: Synthetic oligonucleotide"
uggugcuacuguuuauccgua

SEQ ID NO: 331 - RNA, 21 nt, Artificial Sequence
  source: /note="Description of Artificial Sequence: Synthetic oligonucleotide"
agaaaguguuuuauauacgga

SEQ ID NO: 332 - RNA, 21 nt, Artificial Sequence
  source: /note="Description of Artificial Sequence: Synthetic oligonucleotide"
aacuauuuaugagauguauca

SEQ ID NO: 333 - RNA, 21 nt, Artificial Sequence
  source: /note="Description of Artificial Sequence: Synthetic oligonucleotide"
aguuaaacgaacguacuugca

SEQ ID NO: 334 - RNA, 21 nt, Artificial Sequence
  source: /note="Description of Artificial Sequence: Synthetic oligonucleotide"
caucuucaagccauccuguga

SEQ ID NO: 335 - RNA, 21 nt, Artificial Sequence
  source: /note="Description of Artificial Sequence: Synthetic oligonucleotide"
uuuuuuuucaguauucuugga

SEQ ID NO: 336 - RNA, 21 nt, Artificial Sequence
  source: /note="Description of Artificial Sequence: Synthetic oligonucleotide"
uuauccguaauaauuguggga

SEQ ID NO: 337 - RNA, 21 nt, Artificial Sequence
  source: /note="Description of Artificial Sequence: Synthetic oligonucleotide"
gguacuuauuuaauaucccua

SEQ ID NO: 338 - RNA, 21 nt, Artificial Sequence
  source: /note="Description of Artificial Sequence: Synthetic oligonucleotide"
cacgucuuugucucuagugca

SEQ ID NO: 339 - RNA, 21 nt, Artificial Sequence
  source: /note="Description of Artificial Sequence: Synthetic oligonucleotide"
ugcaaaaacacagacucgcga

SEQ ID NO: 340 - RNA, 21 nt, Artificial Sequence
  source: /note="Description of Artificial Sequence: Synthetic oligonucleotide"
acuauuuaugagauguaucua

SEQ ID NO: 341 - RNA, 21 nt, Artificial Sequence
  source: /note="Description of Artificial Sequence: Synthetic oligonucleotide"
aggggcaaaaacgaaagcgca

SEQ ID NO: 342 - RNA, 21 nt, Artificial Sequence
  source: /note="Description of Artificial Sequence: Synthetic oligonucleotide"
uugcucucuuauuuguaccga

SEQ ID NO: 343 - RNA, 21 nt, Artificial Sequence
  source: /note="Description of Artificial Sequence: Synthetic oligonucleotide"
auuuguuuguacaagauccga

SEQ ID NO: 344 - RNA, 21 nt, Artificial Sequence
  source: /note="Description of Artificial Sequence: Synthetic oligonucleotide"
uugcagaugugacaagccgaa

SEQ ID NO: 345 - RNA, 21 nt, Artificial Sequence
  source: /note="Description of Artificial Sequence: Synthetic oligonucleotide"
caacuauuuaugagauguaua

SEQ ID NO: 346 - RNA, 21 nt, Artificial Sequence
  source: /note="Description of Artificial Sequence: Synthetic oligonucleotide"
aauucuacauacuaaaucuca

SEQ ID NO: 347 - RNA, 21 nt, Artificial Sequence
  source: /note="Description of Artificial Sequence: Synthetic oligonucleotide"
auguccucacaccauugaaaa

SEQ ID NO: 348 - RNA, 21 nt, Artificial Sequence
  source: /note="Description of Artificial Sequence: Synthetic oligonucleotide"
uuguuuguacaagauccgcaa

SEQ ID NO: 349 - RNA, 21 nt, Artificial Sequence
  source: /note="Description of Artificial Sequence: Synthetic oligonucleotide"
uaauccagaaaccugaaauga

SEQ ID NO: 350 - RNA, 21 nt, Artificial Sequence
  source: /note="Description of Artificial Sequence: Synthetic oligonucleotide"
gaaaaaaaaucaguucgagga

SEQ ID NO: 351 - RNA, 21 nt, Artificial Sequence
  source: /note="Description of Artificial Sequence: Synthetic oligonucleotide"
gggcaaaaacgaaagcgcaaa

SEQ ID NO: 352 - RNA, 21 nt, Artificial Sequence
  source: /note="Description of Artificial Sequence: Synthetic oligonucleotide"
ugaaguucauggaugucuaua

SEQ ID NO: 353 - RNA, 21 nt, Artificial Sequence
  source: /note="Description of Artificial Sequence: Synthetic oligonucleotide"
cacgaaguggugaaguucaua

SEQ ID NO: 354 - RNA, 21 nt, Artificial Sequence
  source: /note="Description of Artificial Sequence: Synthetic oligonucleotide"
acgucuuugucucuagugcaa

SEQ ID NO: 355 - RNA, 21 nt, Artificial Sequence
  source: /note="Description of Artificial Sequence: Synthetic oligonucleotide"
aacaucaccaugcagauuaua

SEQ ID NO: 356 - RNA, 21 nt, Artificial Sequence
  source: /note="Description of Artificial Sequence: Synthetic oligonucleotide"
ggugcuacuguuuauccguaa

SEQ ID NO: 357 - RNA, 21 nt, Artificial Sequence
  source: /note="Description of Artificial Sequence: Synthetic oligonucleotide"
aaauagacauugcuauucuga

SEQ ID NO: 358 - RNA, 21 nt, Artificial Sequence
  source: /note="Description of Artificial Sequence: Synthetic oligonucleotide"
uuccccaaaucacuguggaua

SEQ ID NO: 359 - RNA, 21 nt, Artificial Sequence
  source: /note="Description of Artificial Sequence: Synthetic oligonucleotide"
gauccgcagacguguaaauga

SEQ ID NO: 360 - RNA, 21 nt, Artificial Sequence
  source: /note="Description of Artificial Sequence: Synthetic oligonucleotide"
uuaacaucacgucuuugucua

SEQ ID NO: 361 - RNA, 21 nt, Artificial Sequence
  source: /note="Description of Artificial Sequence: Synthetic oligonucleotide"
aaagugagugaccugcuuuua

SEQ ID NO: 362 - RNA, 21 nt, Artificial Sequence
  source: /note="Description of Artificial Sequence: Synthetic oligonucleotide"
aaaaacacagacucgcguuga

SEQ ID NO: 363 - RNA, 21 nt, Artificial Sequence
  source: /note="Description of Artificial Sequence: Synthetic oligonucleotide"
cgucgcacugaaacuuuucga

SEQ ID NO: 364 - RNA, 21 nt, Artificial Sequence
  source: /note="Description of Artificial Sequence: Synthetic oligonucleotide"
aacagugcuaauguuauugga

SEQ ID NO: 365 - RNA, 21 nt, Artificial Sequence
  source: /note="Description of Artificial Sequence: Synthetic oligonucleotide"
uucguccaacuucugggcuga

SEQ ID NO: 366 - RNA, 21 nt, Artificial Sequence
  source: /note="Description of Artificial Sequence: Synthetic oligonucleotide"
auuggugucuucacuggauga

SEQ ID NO: 367 - RNA, 21 nt, Artificial Sequence
  source: /note="Description of Artificial Sequence: Synthetic oligonucleotide"
gcaaaaacacagacucgcgua

SEQ ID NO: 368 - RNA, 21 nt, Artificial Sequence
  source: /note="Description of Artificial Sequence: Synthetic oligonucleotide"
aaaaaucaguucgaggaaaga

SEQ ID NO: 369 - RNA, 21 nt, Artificial Sequence
  source: /note="Description of Artificial Sequence: Synthetic oligonucleotide"
cagacguguaaauguuccuga

SEQ ID NO: 370 - RNA, 21 nt, Artificial Sequence
  source: /note="Description of Artificial Sequence: Synthetic oligonucleotide"
uguccucacaccauugaaaca

SEQ ID NO: 371 - RNA, 21 nt, Artificial Sequence
  source: /note="Description of Artificial Sequence: Synthetic oligonucleotide"
uuuuuuucaguauucuuggua

SEQ ID NO: 372 - RNA, 21 nt, Artificial Sequence
  source: /note="Description of Artificial Sequence: Synthetic oligonucleotide"
agauccgcagacguguaaaua

SEQ ID NO: 373 - RNA, 21 nt, Artificial Sequence
  source: /note="Description of Artificial Sequence: Synthetic oligonucleotide"
cccucuuggaauuggauucga

SEQ ID NO: 374 - RNA, 21 nt, Artificial Sequence
  source: /note="Description of Artificial Sequence: Synthetic oligonucleotide"
gauauuaacaucacgucuuua

SEQ ID NO: 375 - RNA, 21 nt, Artificial Sequence
  source: /note="Description of Artificial Sequence: Synthetic oligonucleotide"
uuggugcuacuguuuauccga

SEQ ID NO: 376 - RNA, 21 nt, Artificial Sequence
  source: /note="Description of Artificial Sequence: Synthetic oligonucleotide"
aaggggcaaaaacgaaagcga

SEQ ID NO: 377 - RNA, 21 nt, Artificial Sequence
  source: /note="Description of Artificial Sequence: Synthetic oligonucleotide"
cuugcagaugugacaagccga

SEQ ID NO: 378 - RNA, 21 nt, Artificial Sequence
  source: /note="Description of Artificial Sequence: Synthetic oligonucleotide"
aaaucaguucgaggaaaggga

SEQ ID NO: 379 - RNA, 21 nt, Artificial Sequence
  source: /note="Description of Artificial Sequence: Synthetic oligonucleotide"
acuuuucguccaacuucugga

SEQ ID NO: 380 - RNA, 21 nt, Artificial Sequence
  source: /note="Description of Artificial Sequence: Synthetic oligonucleotide"
auuaacaucacgucuuuguca

SEQ ID NO: 381 - RNA, 21 nt, Artificial Sequence
  source: /note="Description of Artificial Sequence: Synthetic oligonucleotide"
cgucuuugucucuagugcaga

SEQ ID NO: 382 - RNA, 21 nt, Artificial Sequence
  source: /note="Description of Artificial Sequence: Synthetic oligonucleotide"
aacacagacucgcguugcaaa

SEQ ID NO: 383 - RNA, 21 nt, Artificial Sequence
  source: /note="Description of Artificial Sequence: Synthetic oligonucleotide"
auauuaacaucacgucuuuga

SEQ ID NO: 384 - RNA, 21 nt, Artificial Sequence
  source: /note="Description of Artificial Sequence: Synthetic oligonucleotide"
guuuauccguaauaauuguga

SEQ ID NO: 385 - RNA, 21 nt, Artificial Sequence
  source: /note="Description of Artificial Sequence: Synthetic oligonucleotide"
aaaaucaguucgaggaaagga

SEQ ID NO: 386 - RNA, 21 nt, Artificial Sequence
  source: /note="Description of Artificial Sequence: Synthetic oligonucleotide"
uuuauccguaauaauugugga

SEQ ID NO: 387 - RNA, 21 nt, Artificial Sequence
  source: /note="Description of Artificial Sequence: Synthetic oligonucleotide"
aggacauugcugugcuuugga

SEQ ID NO: 388 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaucgtucuguaucagucuuuc

SEQ ID NO: 389 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggauatuaaauaaguaccguau

SEQ ID NO: 390 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuggatuaaggacuguucuguc

SEQ ID NO: 391 - RNA, 23 nt, Artificial Sequence
  source: /note="Description of Artificial Sequence: Synthetic oligonucleotide"
ugauuaaggacuguucugucgau

SEQ ID NO: 392 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaucutguacaaacaaaugcuu

SEQ ID NO: 393 - RNA, 23 nt, Artificial Sequence
  source: /note="Description of Artificial Sequence: Synthetic oligonucleotide"
uauccagugaagacaccaauaac

SEQ ID NO: 394 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucgatcguucuguaucagucu

SEQ ID NO: 395 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucgutcuguaucagucuuucc

SEQ ID NO: 396 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuguatcgaucguucuguauca

SEQ ID NO: 397 - RNA, 23 nt, Artificial Sequence
  source: /note="Description of Artificial Sequence: Synthetic oligonucleotide"
uuaucgaucguucuguaucaguc

SEQ ID NO: 398 - RNA, 23 nt, Artificial Sequence
  source: /note="Description of Artificial Sequence: Synthetic oligonucleotide"
ucguauauaaaacacuuucucuu

SEQ ID NO: 399 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacauctgcaaguacguucguuu

SEQ ID NO: 400 - RNA, 23 nt, Artificial Sequence
  source: /note="Description of Artificial Sequence: Synthetic oligonucleotide"
uauggcgaauccaauuccaagag

SEQ ID NO: 401 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuucgutuaacucaagcugccuc

SEQ ID NO: 402 - RNA, 23 nt, Artificial Sequence
  source: /note="Description of Artificial Sequence: Synthetic oligonucleotide"
uacuucgugaugauucugcccuc

SEQ ID NO: 403 - RNA, 23 nt, Artificial Sequence
  source: /note="Description of Artificial Sequence: Synthetic oligonucleotide"
ucugcaaguacguucguuuaacu

SEQ ID NO: 404 - RNA, 23 nt, Artificial Sequence
  source: /note="Description of Artificial Sequence: Synthetic oligonucleotide"
uccagugaagacaccaauaacau

SEQ ID NO: 405 - RNA, 23 nt, Artificial Sequence
  source: /note="Description of Artificial Sequence: Synthetic oligonucleotide"
uacguucguuuaacucaagcugc

SEQ ID NO: 406 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguucgtuuaacucaagcugccu

SEQ ID NO: 407 - RNA, 23 nt, Artificial Sequence
  source: /note="Description of Artificial Sequence: Synthetic oligonucleotide"
uccaugaacuucaccacuucgug

SEQ ID NO: 408 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaccactucgugaugauucugcc

SEQ ID NO: 409 - RNA, 23 nt, Artificial Sequence
  source: /note="Description of Artificial Sequence: Synthetic oligonucleotide"
uagaauagcaaugucuauuuuau

SEQ ID NO: 410 - RNA, 23 nt, Artificial Sequence
  source: /note="Description of Artificial Sequence: Synthetic oligonucleotide"
ucguucguuuaacucaagcugcc

SEQ ID NO: 411 - RNA, 23 nt, Artificial Sequence
  source: /note="Description of Artificial Sequence: Synthetic oligonucleotide"
uggacgaaaaguuucagugcgac

SEQ ID NO: 412 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagguutgauccgcauaaucugc

SEQ ID NO: 413 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaccggtacaaauaagagagcaa

SEQ ID NO: 414 - RNA, 23 nt, Artificial Sequence
  source: /note="Description of Artificial Sequence: Synthetic oligonucleotide"
uagauaagcuagugacugucacc

SEQ ID NO: 415 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguacgtucguuuaacucaagcu

SEQ ID NO: 416 - RNA, 23 nt, Artificial Sequence
  source: /note="Description of Artificial Sequence: Synthetic oligonucleotide"
uacaccaauaacauuagcacugu

SEQ ID NO: 417 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacauutacacgucugcggaucu

SEQ ID NO: 418 - RNA, 23 nt, Artificial Sequence
  source: /note="Description of Artificial Sequence: Synthetic oligonucleotide"
ucgaucguucuguaucagucuuu

SEQ ID NO: 419 - RNA, 23 nt, Artificial Sequence
  source: /note="Description of Artificial Sequence: Synthetic oligonucleotide"
ucagugaagacaccaauaacauu

SEQ ID NO: 420 - RNA, 23 nt, Artificial Sequence
  source: /note="Description of Artificial Sequence: Synthetic oligonucleotide"
uugaauaucaaauuccagcaccg

SEQ ID NO: 421 - RNA, 23 nt, Artificial Sequence
  source: /note="Description of Artificial Sequence: Synthetic oligonucleotide"
ugcucggugauuuagcagcaaga

SEQ ID NO: 422 - RNA, 23 nt, Artificial Sequence
  source: /note="Description of Artificial Sequence: Synthetic oligonucleotide"
uuccgcauaaucugcauggugau

SEQ ID NO: 423 - RNA, 23 nt, Artificial Sequence
  source: /note="Description of Artificial Sequence: Synthetic oligonucleotide"
uuuguacaaacaaaugcuuucuc

SEQ ID NO: 424 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuacgutcguuuaacucaagcug

SEQ ID NO: 425 - RNA, 23 nt, Artificial Sequence
  source: /note="Description of Artificial Sequence: Synthetic oligonucleotide"
uaagcuagugacugucaccgauc

SEQ ID NO: 426 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucguutaacucaagcugccucg

SEQ ID NO: 427 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcgagtcuguguuuuugcagga

SEQ ID NO: 428 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucucggtgauuuagcagcaagaa

SEQ ID NO: 429 - RNA, 23 nt, Artificial Sequence
  source: /note="Description of Artificial Sequence: Synthetic oligonucleotide"
ucggugauuuagcagcaagaaaa

SEQ ID NO: 430 - RNA, 23 nt, Artificial Sequence
  source: /note="Description of Artificial Sequence: Synthetic oligonucleotide"
ucuuguacaaacaaaugcuuucu

SEQ ID NO: 431 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacautuacacgucugcggauc

SEQ ID NO: 432 - RNA, 23 nt, Artificial Sequence
  source: /note="Description of Artificial Sequence: Synthetic oligonucleotide"
ugggauauuaaauaaguaccgua

SEQ ID NO: 433 - RNA, 23 nt, Artificial Sequence
  source: /note="Description of Artificial Sequence: Synthetic oligonucleotide"
uucgaucguucuguaucagucuu

SEQ ID NO: 434 - RNA, 23 nt, Artificial Sequence
  source: /note="Description of Artificial Sequence: Synthetic oligonucleotide"
ugcaacgcgagucuguguuuuug

SEQ ID NO: 435 - RNA, 23 nt, Artificial Sequence
  source: /note="Description of Artificial Sequence: Synthetic oligonucleotide"
ucaaguacguucguuuaacucaa

SEQ ID NO: 436 - RNA, 23 nt, Artificial Sequence
  source: /note="Description of Artificial Sequence: Synthetic oligonucleotide"
ucagucaaauacauccagugaag

SEQ ID NO: 437 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaagutcaugguuucggaggcc

SEQ ID NO: 438 - RNA, 23 nt, Artificial Sequence
  source: /note="Description of Artificial Sequence: Synthetic oligonucleotide"
uaguacguucguuuaacucaagc

SEQ ID NO: 439 - RNA, 23 nt, Artificial Sequence
  source: /note="Description of Artificial Sequence: Synthetic oligonucleotide"
uauuacggauaaacaguagcacc

SEQ ID NO: 440 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaacatuuacacgucugcggau

SEQ ID NO: 441 - RNA, 23 nt, Artificial Sequence
  source: /note="Description of Artificial Sequence: Synthetic oligonucleotide"
uggaacauuuacacgucugcgga

SEQ ID NO: 442 - RNA, 23 nt, Artificial Sequence
  source: /note="Description of Artificial Sequence: Synthetic oligonucleotide"
ucaacaaugugucucuucucuuc

SEQ ID NO: 443 - RNA, 23 nt, Artificial Sequence
  source: /note="Description of Artificial Sequence: Synthetic oligonucleotide"
uauucacauuuguugugcuguag

SEQ ID NO: 444 - RNA, 23 nt, Artificial Sequence
  source: /note="Description of Artificial Sequence: Synthetic oligonucleotide"
uucggugauuuagcagcaagaaa

SEQ ID NO: 445 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuagtgguuucaaugguguga

SEQ ID NO: 446 - RNA, 23 nt, Artificial Sequence
  source: /note="Description of Artificial Sequence: Synthetic oligonucleotide"
ucguuuaacucaagcugccucgc

SEQ ID NO: 447 - RNA, 23 nt, Artificial Sequence
  source: /note="Description of Artificial Sequence: Synthetic oligonucleotide"
uuggacgaaaaguuucagugcga

SEQ ID NO: 448 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauaagtaccguauauaaaacac

SEQ ID NO: 449 - RNA, 23 nt, Artificial Sequence
  source: /note="Description of Artificial Sequence: Synthetic oligonucleotide"
uaacuagugguuucaauggugug

SEQ ID NO: 450 - RNA, 23 nt, Artificial Sequence
  source: /note="Description of Artificial Sequence: Synthetic oligonucleotide"
ucgcauaaucugcauggugaugu

SEQ ID NO: 451 - RNA, 23 nt, Artificial Sequence
  source: /note="Description of Artificial Sequence: Synthetic oligonucleotide"
uaaguacguucguuuaacucaag

SEQ ID NO: 452 - RNA, 23 nt, Artificial Sequence
  source: /note="Description of Artificial Sequence: Synthetic oligonucleotide"
uaccguauauaaaacacuuucuc

SEQ ID NO: 453 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaagataagcuagugacuguca

SEQ ID NO: 454 - RNA, 23 nt, Artificial Sequence
  source: /note="Description of Artificial Sequence: Synthetic oligonucleotide"
uuuacggauaaacaguagcacca

SEQ ID NO: 455 - RNA, 23 nt, Artificial Sequence
  source: /note="Description of Artificial Sequence: Synthetic oligonucleotide"
ucgagucuguguuuuugcaggaa

SEQ ID NO: 456 - RNA, 23 nt, Artificial Sequence
  source: /note="Description of Artificial Sequence: Synthetic oligonucleotide"
uaacgcgagucuguguuuuugca

SEQ ID NO: 457 - RNA, 23 nt, Artificial Sequence
  source: /note="Description of Artificial Sequence: Synthetic oligonucleotide"
ucccaacucaaguccacagcagu

SEQ ID NO: 458 - RNA, 23 nt, Artificial Sequence
  source: /note="Description of Artificial Sequence: Synthetic oligonucleotide"
ugacaccaauaacauuagcacug

SEQ ID NO: 459 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggataaacaguagcaccaau

SEQ ID NO: 460 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccguatauaaaacacuuucucu

SEQ ID NO: 461 - RNA, 23 nt, Artificial Sequence
  source: /note="Description of Artificial Sequence: Synthetic oligonucleotide"
ugauacaucucauaaauaguuga

SEQ ID NO: 462 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaagtacguucguuuaacuca

SEQ ID NO: 463 - RNA, 23 nt, Artificial Sequence
  source: /note="Description of Artificial Sequence: Synthetic oligonucleotide"
ucacaggauggcuugaagaugua

SEQ ID NO: 464 - RNA, 23 nt, Artificial Sequence
  source: /note="Description of Artificial Sequence: Synthetic oligonucleotide"
uccaagaauacugaaaaaaaacc

SEQ ID NO: 465 - RNA, 23 nt, Artificial Sequence
  source: /note="Description of Artificial Sequence: Synthetic oligonucleotide"
ucccacaauuauuacggauaaac

SEQ ID NO: 466 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagggatauuaaauaaguaccgu

SEQ ID NO: 467 - RNA, 23 nt, Artificial Sequence
  source: /note="Description of Artificial Sequence: Synthetic oligonucleotide"
ugcacuagagacaaagacgugau

SEQ ID NO: 468 - RNA, 23 nt, Artificial Sequence
  source: /note="Description of Artificial Sequence: Synthetic oligonucleotide"
ucgcgagucuguguuuuugcagg

SEQ ID NO: 469 - RNA, 23 nt, Artificial Sequence
  source: /note="Description of Artificial Sequence: Synthetic oligonucleotide"
uagauacaucucauaaauaguug

SEQ ID NO: 470 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcgcutucguuuuugccccuuu

SEQ ID NO: 471 - RNA, 23 nt, Artificial Sequence
  source: /note="Description of Artificial Sequence: Synthetic oligonucleotide"
ucgguacaaauaagagagcaaga

SEQ ID NO: 472 - RNA, 23 nt, Artificial Sequence
  source: /note="Description of Artificial Sequence: Synthetic oligonucleotide"
ucggaucuuguacaaacaaaugc

SEQ ID NO: 473 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucggctugucacaucugcaagu

SEQ ID NO: 474 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauacatcucauaaauaguugaa

SEQ ID NO: 475 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagautuaguauguagaauucu

SEQ ID NO: 476 - RNA, 23 nt, Artificial Sequence
  source: /note="Description of Artificial Sequence: Synthetic oligonucleotide"
uuuucaauggugugaggacauag

SEQ ID NO: 477 - RNA, 23 nt, Artificial Sequence
  source: /note="Description of Artificial Sequence: Synthetic oligonucleotide"
uugcggaucuuguacaaacaaau

SEQ ID NO: 478 - RNA, 23 nt, Artificial Sequence
  source: /note="Description of Artificial Sequence: Synthetic oligonucleotide"
ucauuucagguuucuggauuaag

SEQ ID NO: 479 - RNA, 23 nt, Artificial Sequence
  source: /note="Description of Artificial Sequence: Synthetic oligonucleotide"
uccucgaacugauuuuuuuucuu

SEQ ID NO: 480 - RNA, 23 nt, Artificial Sequence
  source: /note="Description of Artificial Sequence: Synthetic oligonucleotide"
uuugcgcuuucguuuuugccccu

SEQ ID NO: 481 - RNA, 23 nt, Artificial Sequence
  source: /note="Description of Artificial Sequence: Synthetic oligonucleotide"
uauagacauccaugaacuucacc

SEQ ID NO: 482 - RNA, 23 nt, Artificial Sequence
  source: /note="Description of Artificial Sequence: Synthetic oligonucleotide"
uaugaacuucaccacuucgugau

SEQ ID NO: 483 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugcactagagacaaagacguga

SEQ ID NO: 484 - RNA, 23 nt, Artificial Sequence
  source: /note="Description of Artificial Sequence: Synthetic oligonucleotide"
uauaaucugcauggugauguugg

SEQ ID NO: 485 - RNA, 23 nt, Artificial Sequence
  source: /note="Description of Artificial Sequence: Synthetic oligonucleotide"
uuacggauaaacaguagcaccaa

SEQ ID NO: 486 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagaatagcaaugucuauuuua

SEQ ID NO: 487 - RNA, 23 nt, Artificial Sequence
  source: /note="Description of Artificial Sequence: Synthetic oligonucleotide"
uauccacagugauuuggggaagu

SEQ ID NO: 488 - RNA, 23 nt, Artificial Sequence
  source: /note="Description of Artificial Sequence: Synthetic oligonucleotide"
ucauuuacacgucugcggaucuu

SEQ ID NO: 489 - RNA, 23 nt, Artificial Sequence
  source: /note="Description of Artificial Sequence: Synthetic oligonucleotide"
uagacaaagacgugauguuaaua

SEQ ID NO: 490 - RNA, 23 nt, Artificial Sequence
  source: /note="Description of Artificial Sequence: Synthetic oligonucleotide"
uaaaagcaggucacucacuuugc

SEQ ID NO: 491 - RNA, 23 nt, Artificial Sequence
  source: /note="Description of Artificial Sequence: Synthetic oligonucleotide"
ucaacgcgagucuguguuuuugc

SEQ ID NO: 492 - RNA, 23 nt, Artificial Sequence
  source: /note="Description of Artificial Sequence: Synthetic oligonucleotide"
ucgaaaaguuucagugcgacgcc

SEQ ID NO: 493 - RNA, 23 nt, Artificial Sequence
  source: /note="Description of Artificial Sequence: Synthetic oligonucleotide"
uccaauaacauuagcacuguuaa

SEQ ID NO: 494 - RNA, 23 nt, Artificial Sequence
  source: /note="Description of Artificial Sequence: Synthetic oligonucleotide"
ucagcccagaaguuggacgaaaa

SEQ ID NO: 495 - RNA, 23 nt, Artificial Sequence
  source: /note="Description of Artificial Sequence: Synthetic oligonucleotide"
ucauccagugaagacaccaauaa

SEQ ID NO: 496 - RNA, 23 nt, Artificial Sequence
  source: /note="Description of Artificial Sequence: Synthetic oligonucleotide"
uacgcgagucuguguuuuugcag

SEQ ID NO: 497 - RNA, 23 nt, Artificial Sequence
  source: /note="Description of Artificial Sequence: Synthetic oligonucleotide"
ucuuuccucgaacugauuuuuuu

SEQ ID NO: 498 - RNA, 23 nt, Artificial Sequence
  source: /note="Description of Artificial Sequence: Synthetic oligonucleotide"
ucaggaacauuuacacgucugcg

SEQ ID NO: 499 - RNA, 23 nt, Artificial Sequence
  source: /note="Description of Artificial Sequence: Synthetic oligonucleotide"
uguuucaauggugugaggacaua

SEQ ID NO: 500 - RNA, 23 nt, Artificial Sequence
  source: /note="Description of Artificial Sequence: Synthetic oligonucleotide"
uaccaagaauacugaaaaaaaac

SEQ ID NO: 501 - RNA, 23 nt, Artificial Sequence
  source: /note="Description of Artificial Sequence: Synthetic oligonucleotide"
uauuuacacgucugcggaucuug

SEQ ID NO: 502 - RNA, 23 nt, Artificial Sequence
  source: /note="Description of Artificial Sequence: Synthetic oligonucleotide"
ucgaauccaauuccaagagggac

SEQ ID NO: 503 - RNA, 23 nt, Artificial Sequence
  source: /note="Description of Artificial Sequence: Synthetic oligonucleotide"
uaaagacgugauguuaauaucuu

SEQ ID NO: 504 - RNA, 23 nt, Artificial Sequence
  source: /note="Description of Artificial Sequence: Synthetic oligonucleotide"
ucggauaaacaguagcaccaaua

SEQ ID NO: 505 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgcuutcguuuuugccccuuuc

SEQ ID NO: 506 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggcutgucacaucugcaagua

SEQ ID NO: 507 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucccuutccucgaacugauuuuu

SEQ ID NO: 508 - RNA, 23 nt, Artificial Sequence
  source: /note="Description of Artificial Sequence: Synthetic oligonucleotide"
uccagaaguuggacgaaaaguuu

SEQ ID NO: 509 - RNA, 23 nt, Artificial Sequence
  source: /note="Description of Artificial Sequence: Synthetic oligonucleotide"
ugacaaagacgugauguuaauau

SEQ ID NO: 510 - RNA, 23 nt, Artificial Sequence
  source: /note="Description of Artificial Sequence: Synthetic oligonucleotide"
ucugcacuagagacaaagacgug

SEQ ID NO: 511 - RNA, 23 nt, Artificial Sequence
  source: /note="Description of Artificial Sequence: Synthetic oligonucleotide"
uuugcaacgcgagucuguguuuu

SEQ ID NO: 512 - RNA, 23 nt, Artificial Sequence
  source: /note="Description of Artificial Sequence: Synthetic oligonucleotide"
ucaaagacgugauguuaauaucu

SEQ ID NO: 513 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacaatuauuacggauaaacag

SEQ ID NO: 514 - RNA, 23 nt, Artificial Sequence
  source: /note="Description of Artificial Sequence: Synthetic oligonucleotide"
uccuuuccucgaacugauuuuuu

SEQ ID NO: 515 - RNA, 23 nt, Artificial Sequence
  source: /note="Description of Artificial Sequence: Synthetic oligonucleotide"
uccacaauuauuacggauaaaca

SEQ ID NO: 516 - RNA, 23 nt, Artificial Sequence
  source: /note="Description of Artificial Sequence: Synthetic oligonucleotide"
uccaaagcacagcaauguccuga

SEQ ID NO: 517 - RNA, 21 nt, Artificial Sequence
  source: /note="Description of Artificial Sequence: Synthetic oligonucleotide"
acugauacagaacgaucgaua

SEQ ID NO: 518 - RNA, 21 nt, Artificial Sequence
  source: /note="Description of Artificial Sequence: Synthetic oligonucleotide"
aaagacugauacagaacgaua

SEQ ID NO: 519 - RNA, 21 nt, Artificial Sequence
  source: /note="Description of Artificial Sequence: Synthetic oligonucleotide"
gagaaaguguuuuauauacga

SEQ ID NO: 520 - RNA, 21 nt, Artificial Sequence
  source: /note="Description of Artificial Sequence: Synthetic oligonucleotide"
agacugauacagaacgaucga

SEQ ID NO: 521 - RNA, 21 nt, Artificial Sequence
  source: /note="Description of Artificial Sequence: Synthetic oligonucleotide"
caacuauuuaugagauguaua

SEQ ID NO: 522 - RNA, 21 nt, Artificial Sequence
  source: /note="Description of Artificial Sequence: Synthetic oligonucleotide"
aagacugauacagaacgauca

SEQ ID NO: 523 - RNA, 21 nt, Artificial Sequence
  source: /note="Description of Artificial Sequence: Synthetic oligonucleotide"
auacagaacgaucgauacaga

SEQ ID NO: 524 - RNA, 21 nt, Artificial Sequence
  source: /note="Description of Artificial Sequence: Synthetic oligonucleotide"
aacagugcuaauguuauugga

SEQ ID NO: 525 - RNA, 21 nt, Artificial Sequence
  source: /note="Description of Artificial Sequence: Synthetic oligonucleotide"
gugcuaauguuauugguguca

SEQ ID NO: 526 - RNA, 21 nt, Artificial Sequence
  source: /note="Description of Artificial Sequence: Synthetic oligonucleotide"
aacuauuuaugagauguauca

SEQ ID NO: 527 - RNA, 21 nt, Artificial Sequence
  source: /note="Description of Artificial Sequence: Synthetic oligonucleotide"
cagaacaguccuuaauccaga

SEQ ID NO: 528 - RNA, 21 nt, Artificial Sequence
  source: /note="Description of Artificial Sequence: Synthetic oligonucleotide"
gacugauacagaacgaucgaa

SEQ ID NO: 529 - RNA, 21 nt, Artificial Sequence
  source: /note="Description of Artificial Sequence: Synthetic oligonucleotide"
acagcacaacaaaugugaaua

SEQ ID NO: 530 - RNA, 21 nt, Artificial Sequence
  source: /note="Description of Artificial Sequence: Synthetic oligonucleotide"
aaauagacauugcuauucuga

SEQ ID NO: 531 - RNA, 21 nt, Artificial Sequence
  source: /note="Description of Artificial Sequence: Synthetic oligonucleotide"
uauuggugucuucacuggaua

SEQ ID NO: 532 - RNA, 21 nt, Artificial Sequence
  source: /note="Description of Artificial Sequence: Synthetic oligonucleotide"
cugauacagaacgaucgauaa

SEQ ID NO: 533 - RNA, 21 nt, Artificial Sequence
  source: /note="Description of Artificial Sequence: Synthetic oligonucleotide"
gcucucuuauuuguaccggua

SEQ ID NO: 534 - RNA, 21 nt, Artificial Sequence
  source: /note="Description of Artificial Sequence: Synthetic oligonucleotide"
caccauugaaaccacuaguua

SEQ ID NO: 535 - RNA, 21 nt, Artificial Sequence
  source: /note="Description of Artificial Sequence: Synthetic oligonucleotide"
ggcagcuugaguuaaacgaaa

SEQ ID NO: 536 - RNA, 21 nt, Artificial Sequence
  source: /note="Description of Artificial Sequence: Synthetic oligonucleotide"
uuaaacgaacguacuugcaga

SEQ ID NO: 537 - RNA, 21 nt, Artificial Sequence
  source: /note="Description of Artificial Sequence: Synthetic oligonucleotide"
ucggugacagucacuagcuua

SEQ ID NO: 538 - RNA, 21 nt, Artificial Sequence
  source: /note="Description of Artificial Sequence: Synthetic oligonucleotide"
aguuaaacgaacguacuugca

SEQ ID NO: 539 - RNA, 21 nt, Artificial Sequence
  source: /note="Description of Artificial Sequence: Synthetic oligonucleotide"
gcagcuugaguuaaacgaaca

SEQ ID NO: 540 - RNA, 21 nt, Artificial Sequence
  source: /note="Description of Artificial Sequence: Synthetic oligonucleotide"
agugcuaauguuauuggugua

SEQ ID NO: 541 - RNA, 21 nt, Artificial Sequence
  source: /note="Description of Artificial Sequence: Synthetic oligonucleotide"
cgaaguggugaaguucaugga

SEQ ID NO: 542 - RNA, 21 nt, Artificial Sequence
  source: /note="Description of Artificial Sequence: Synthetic oligonucleotide"
aaagcauuuguuuguacaaga

SEQ ID NO: 543 - RNA, 21 nt, Artificial Sequence
  source: /note="Description of Artificial Sequence: Synthetic oligonucleotide"
auguccucacaccauugaaaa

SEQ ID NO: 544 - RNA, 21 nt, Artificial Sequence
  source: /note="Description of Artificial Sequence: Synthetic oligonucleotide"
ugaguuaaacgaacguacuua

SEQ ID NO: 545 - RNA, 21 nt, Artificial Sequence
  source: /note="Description of Artificial Sequence: Synthetic oligonucleotide"
acaccauugaaaccacuagua

SEQ ID NO: 546 - RNA, 21 nt, Artificial Sequence
  source: /note="Description of Artificial Sequence: Synthetic oligonucleotide"
caaaaacacagacucgcguua

SEQ ID NO: 547 - RNA, 21 nt, Artificial Sequence
  source: /note="Description of Artificial Sequence: Synthetic oligonucleotide"
uguccucacaccauugaaaca

SEQ ID NO: 548 - RNA, 21 nt, Artificial Sequence
  source: /note="Description of Artificial Sequence: Synthetic oligonucleotide"
cagcuugaguuaaacgaacga

SEQ ID NO: 549 - RNA, 21 nt, Artificial Sequence
  source: /note="Description of Artificial Sequence: Synthetic oligonucleotide"
ggugcuacuguuuauccguaa

SEQ ID NO: 550 - RNA, 21 nt, Artificial Sequence
  source: /note="Description of Artificial Sequence: Synthetic oligonucleotide"
uugcucucuuauuuguaccga

SEQ ID NO: 551 - RNA, 21 nt, Artificial Sequence
  source: /note="Description of Artificial Sequence: Synthetic oligonucleotide"
ucuugcugcuaaaucaccgaa

SEQ ID NO: 552 - RNA, 21 nt, Artificial Sequence
  source: /note="Description of Artificial Sequence: Synthetic oligonucleotide"
cgguacuuauuuaauauccca

SEQ ID NO: 553 - RNA, 21 nt, Artificial Sequence
  source: /note="Description of Artificial Sequence: Synthetic oligonucleotide"
aaaauagacauugcuauucua

SEQ ID NO: 554 - RNA, 21 nt, Artificial Sequence
  source: /note="Description of Artificial Sequence: Synthetic oligonucleotide"
acuuuucguccaacuucugga

SEQ ID NO: 555 - RNA, 21 nt, Artificial Sequence
  source: /note="Description of Artificial Sequence: Synthetic oligonucleotide"
uuggugcuacuguuuauccga

SEQ ID NO: 556 - RNA, 21 nt, Artificial Sequence
  source: /note="Description of Artificial Sequence: Synthetic oligonucleotide"
guuauuggugucuucacugga

SEQ ID NO: 557 - RNA, 21 nt, Artificial Sequence
  source: /note="Description of Artificial Sequence: Synthetic oligonucleotide"
uucguccaacuucugggcuga

SEQ ID NO: 558 - RNA, 21 nt, Artificial Sequence
  source: /note="Description of Artificial Sequence: Synthetic oligonucleotide"
uucuugcugcuaaaucaccga

SEQ ID NO: 559 - RNA, 21 nt, Artificial Sequence
  source: /note="Description of Artificial Sequence: Synthetic oligonucleotide"
gguacuuauuuaauaucccua

SEQ ID NO: 560 - RNA, 21 nt, Artificial Sequence
  source: /note="Description of Artificial Sequence: Synthetic oligonucleotide"
auauuaacaucacgucuuuga

SEQ ID NO: 561 - RNA, 21 nt, Artificial Sequence
  source: /note="Description of Artificial Sequence: Synthetic oligonucleotide"
gaggcagcuugaguuaaacga

SEQ ID NO: 562 - RNA, 21 nt, Artificial Sequence
  source: /note="Description of Artificial Sequence: Synthetic oligonucleotide"
gugcuacuguuuauccguaaa

SEQ ID NO: 563 - RNA, 21 nt, Artificial Sequence
  source: /note="Description of Artificial Sequence: Synthetic oligonucleotide"
aggcagcuugaguuaaacgaa

SEQ ID NO: 564 - RNA, 21 nt, Artificial Sequence
  source: /note="Description of Artificial Sequence: Synthetic oligonucleotide"
uggugcuacuguuuauccgua

SEQ ID NO: 565 - RNA, 21 nt, Artificial Sequence
  source: /note="Description of Artificial Sequence: Synthetic oligonucleotide"
aaggggcaaaaacgaaagcga

SEQ ID NO: 566 - RNA, 21 nt, Artificial Sequence
  source: /note="Description of Artificial Sequence: Synthetic oligonucleotide"
acagucacuagcuuaucuuga

SEQ ID NO: 567 - RNA, 21 nt, Artificial Sequence
  source: /note="Description of Artificial Sequence: Synthetic oligonucleotide"
acgguacuuauuuaauaucca

SEQ ID NO: 568 - RNA, 21 nt, Artificial Sequence
  source: /note="Description of Artificial Sequence: Synthetic oligonucleotide"
gaguuaaacgaacguacuuga

SEQ ID NO: 569 - RNA, 21 nt, Artificial Sequence
  source: /note="Description of Artificial Sequence: Synthetic oligonucleotide"
uguuauuggugucuucacuga

SEQ ID NO: 570 - RNA, 21 nt, Artificial Sequence
  source: /note="Description of Artificial Sequence: Synthetic oligonucleotide"
cgacagaacaguccuuaauca

SEQ ID NO: 571 - RNA, 21 nt, Artificial Sequence
  source: /note="Description of Artificial Sequence: Synthetic oligonucleotide"
aaaaucaguucgaggaaagga

SEQ ID NO: 572 - RNA, 21 nt, Artificial Sequence
  source: /note="Description of Artificial Sequence: Synthetic oligonucleotide"
cuuggaauuggauucgccaua

SEQ ID NO: 573 - RNA, 21 nt, Artificial Sequence
  source: /note="Description of Artificial Sequence: Synthetic oligonucleotide"
agagaagagacacauuguuga

SEQ ID NO: 574 - RNA, 21 nt, Artificial Sequence
  source: /note="Description of Artificial Sequence: Synthetic oligonucleotide"
acgucuuugucucuagugcaa

SEQ ID NO: 575 - RNA, 21 nt, Artificial Sequence
  source: /note="Description of Artificial Sequence: Synthetic oligonucleotide"
ugacagucacuagcuuaucua

SEQ ID NO: 576 - RNA, 21 nt, Artificial Sequence
  source: /note="Description of Artificial Sequence: Synthetic oligonucleotide"
uugaguuaaacgaacguacua

SEQ ID NO: 577 - RNA, 21 nt, Artificial Sequence
  source: /note="Description of Artificial Sequence: Synthetic oligonucleotide"
gaaagcauuuguuuguacaaa

SEQ ID NO: 578 - RNA, 21 nt, Artificial Sequence
  source: /note="Description of Artificial Sequence: Synthetic oligonucleotide"
aucaccaugcagauuaugcga

SEQ ID NO: 579 - RNA, 21 nt, Artificial Sequence
  source: /note="Description of Artificial Sequence: Synthetic oligonucleotide"
caccaugcagauuaugcggaa

SEQ ID NO: 580 - RNA, 21 nt, Artificial Sequence
  source: /note="Description of Artificial Sequence: Synthetic oligonucleotide"
cuugaguuaaacgaacguaca

SEQ ID NO: 581 - RNA, 21 nt, Artificial Sequence
  source: /note="Description of Artificial Sequence: Synthetic oligonucleotide"
uugcagaugugacaagccgaa

SEQ ID NO: 582 - RNA, 21 nt, Artificial Sequence
  source: /note="Description of Artificial Sequence: Synthetic oligonucleotide"
acuauuuaugagauguaucua

SEQ ID NO: 583 - RNA, 21 nt, Artificial Sequence
  source: /note="Description of Artificial Sequence: Synthetic oligonucleotide"
uuuuuuuucaguauucuugga

SEQ ID NO: 584 - RNA, 21 nt, Artificial Sequence
  source: /note="Description of Artificial Sequence: Synthetic oligonucleotide"
guuuuauauacgguacuuaua

SEQ ID NO: 585 - RNA, 21 nt, Artificial Sequence
  source: /note="Description of Artificial Sequence: Synthetic oligonucleotide"
gaaaguguuuuauauacggua

SEQ ID NO: 586 - RNA, 21 nt, Artificial Sequence
  source: /note="Description of Artificial Sequence: Synthetic oligonucleotide"
ucacuggauguauuugacuga

SEQ ID NO: 587 - RNA, 21 nt, Artificial Sequence
  source: /note="Description of Artificial Sequence: Synthetic oligonucleotide"
gcuugaguuaaacgaacguaa

SEQ ID NO: 588 - RNA, 21 nt, Artificial Sequence
  source: /note="Description of Artificial Sequence: Synthetic oligonucleotide"
ccuccgaaaccaugaacuuua

SEQ ID NO: 589 - RNA, 21 nt, Artificial Sequence
  source: /note="Description of Artificial Sequence: Synthetic oligonucleotide"
aaaaaucaguucgaggaaaga

SEQ ID NO: 590 - RNA, 21 nt, Artificial Sequence
  source: /note="Description of Artificial Sequence: Synthetic oligonucleotide"
gagaauucuacauacuaaaua

SEQ ID NO: 591 - RNA, 21 nt, Artificial Sequence
  source: /note="Description of Artificial Sequence: Synthetic oligonucleotide"
agauuaugcggaucaaaccua

SEQ ID NO: 592 - RNA, 21 nt, Artificial Sequence
  source: /note="Description of Artificial Sequence: Synthetic oligonucleotide"
aaaucaguucgaggaaaggga

SEQ ID NO: 593 - RNA, 21 nt, Artificial Sequence
  source: /note="Description of Artificial Sequence: Synthetic oligonucleotide"
gcauuuguuuguacaagauca

SEQ ID NO: 594 - RNA, 21 nt, Artificial Sequence
  source: /note="Description of Artificial Sequence: Synthetic oligonucleotide"
cacgaaguggugaaguucaua

SEQ ID NO: 595 - RNA, 21 nt, Artificial Sequence
  source: /note="Description of Artificial Sequence: Synthetic oligonucleotide"
uaauccagaaaccugaaauga

SEQ ID NO: 596 - RNA, 21 nt, Artificial Sequence
  source: /note="Description of Artificial Sequence: Synthetic oligonucleotide"
caucuucaagccauccuguga

SEQ ID NO: 597 - RNA, 21 nt, Artificial Sequence
  source: /note="Description of Artificial Sequence: Synthetic oligonucleotide"
ugcuacuguuuauccguaaua

SEQ ID NO: 598 - RNA, 21 nt, Artificial Sequence
  source: /note="Description of Artificial Sequence: Synthetic oligonucleotide"
uugcugcuaaaucaccgagca

SEQ ID NO: 599 - RNA, 21 nt, Artificial Sequence
  source: /note="Description of Artificial Sequence: Synthetic oligonucleotide"
gauauuaacaucacgucuuua

SEQ ID NO: 600 - RNA, 21 nt, Artificial Sequence
  source: /note="Description of Artificial Sequence: Synthetic oligonucleotide"
cugcaaaaacacagacucgca

SEQ ID NO: 601 - RNA, 21 nt, Artificial Sequence
  source: /note="Description of Artificial Sequence: Synthetic oligonucleotide"
cuugcugcuaaaucaccgaga

SEQ ID NO: 602 - RNA, 21 nt, Artificial Sequence
  source: /note="Description of Artificial Sequence: Synthetic oligonucleotide"
agaaaguguuuuauauacgga

SEQ ID NO: 603 - RNA, 21 nt, Artificial Sequence
  source: /note="Description of Artificial Sequence: Synthetic oligonucleotide"
aacaucaccaugcagauuaua

SEQ ID NO: 604 - RNA, 21 nt, Artificial Sequence
  source: /note="Description of Artificial Sequence: Synthetic oligonucleotide"
cgcagacguguaaauguucca

SEQ ID NO: 605 - RNA, 21 nt, Artificial Sequence
  source: /note="Description of Artificial Sequence: Synthetic oligonucleotide"
agcuugaguuaaacgaacgua

SEQ ID NO: 606 - RNA, 21 nt, Artificial Sequence
  source: /note="Description of Artificial Sequence: Synthetic oligonucleotide"
gcacugaaacuuuucguccaa

SEQ ID NO: 607 - RNA, 21 nt, Artificial Sequence
  source: /note="Description of Artificial Sequence: Synthetic oligonucleotide"
aauucuacauacuaaaucuca

SEQ ID NO: 608 - RNA, 21 nt, Artificial Sequence
  source: /note="Description of Artificial Sequence: Synthetic oligonucleotide"
ccgcagacguguaaauguuca

SEQ ID NO: 609 - RNA, 21 nt, Artificial Sequence
  source: /note="Description of Artificial Sequence: Synthetic oligonucleotide"
uccgcagacguguaaauguua

SEQ ID NO: 610 - RNA, 21 nt, Artificial Sequence
  source: /note="Description of Artificial Sequence: Synthetic oligonucleotide"
cgcacugaaacuuuucgucca

SEQ ID NO: 611 - RNA, 21 nt, Artificial Sequence
  source: /note="Description of Artificial Sequence: Synthetic oligonucleotide"
cccucuuggaauuggauucga

SEQ ID NO: 612 - RNA, 21 nt, Artificial Sequence
  source: /note="Description of Artificial Sequence: Synthetic oligonucleotide"
cagacguguaaauguuccuga

SEQ ID NO: 613 - RNA, 21 nt, Artificial Sequence
  source: /note="Description of Artificial Sequence: Synthetic oligonucleotide"
acgaacguacuugcagaugua

SEQ ID NO: 614 - RNA, 21 nt, Artificial Sequence
  source: /note="Description of Artificial Sequence: Synthetic oligonucleotide"
auccgcagacguguaaaugua

SEQ ID NO: 615 - RNA, 21 nt, Artificial Sequence
  source: /note="Description of Artificial Sequence: Synthetic oligonucleotide"
cagaaucaucacgaaguggua

SEQ ID NO: 616 - RNA, 21 nt, Artificial Sequence
  source: /note="Description of Artificial Sequence: Synthetic oligonucleotide"
ccugcaaaaacacagacucga

SEQ ID NO: 617 - RNA, 21 nt, Artificial Sequence
  source: /note="Description of Artificial Sequence: Synthetic oligonucleotide"
aggacauugcugugcuuugga

SEQ ID NO: 618 - RNA, 21 nt, Artificial Sequence
  source: /note="Description of Artificial Sequence: Synthetic oligonucleotide"
gggcagaaucaucacgaagua

SEQ ID NO: 619 - RNA, 21 nt, Artificial Sequence
  source: /note="Description of Artificial Sequence: Synthetic oligonucleotide"
ugaaguucauggaugucuaua

SEQ ID NO: 620 - RNA, 21 nt, Artificial Sequence
  source: /note="Description of Artificial Sequence: Synthetic oligonucleotide"
cgucgcacugaaacuuuucga

SEQ ID NO: 621 - RNA, 21 nt, Artificial Sequence
  source: /note="Description of Artificial Sequence: Synthetic oligonucleotide"
gaaaaaaaaucaguucgagga

SEQ ID NO: 622 - RNA, 21 nt, Artificial Sequence
  source: /note="Description of Artificial Sequence: Synthetic oligonucleotide"
auuggugucuucacuggauga

SEQ ID NO: 623 - RNA, 21 nt, Artificial Sequence
  source: /note="Description of Artificial Sequence: Synthetic oligonucleotide"
agauccgcagacguguaaaua

SEQ ID NO: 624 - RNA, 21 nt, Artificial Sequence
  source: /note="Description of Artificial Sequence: Synthetic oligonucleotide"
gauccgcagacguguaaauga

SEQ ID NO: 625 - RNA, 21 nt, Artificial Sequence
  source: /note="Description of Artificial Sequence: Synthetic oligonucleotide"
uuguuuguacaagauccgcaa

SEQ ID NO: 626 - RNA, 21 nt, Artificial Sequence
  source: /note="Description of Artificial Sequence: Synthetic oligonucleotide"
ugcuguggacuugaguuggga

SEQ ID NO: 627 - RNA, 21 nt, Artificial Sequence
  source: /note="Description of Artificial Sequence: Synthetic oligonucleotide"
cacgucuuugucucuagugca

SEQ ID NO: 628 - RNA, 21 nt, Artificial Sequence
  source: /note="Description of Artificial Sequence: Synthetic oligonucleotide"
uuuuuuucaguauucuuggua

SEQ ID NO: 629 - RNA, 21 nt, Artificial Sequence
  source: /note="Description of Artificial Sequence: Synthetic oligonucleotide"
gugcuggaauuugauauucaa

SEQ ID NO: 630 - RNA, 21 nt, Artificial Sequence
  source: /note="Description of Artificial Sequence: Synthetic oligonucleotide"
uuaacaucacgucuuugucua

SEQ ID NO: 631 - RNA, 21 nt, Artificial Sequence
  source: /note="Description of Artificial Sequence: Synthetic oligonucleotide"
aggggcaaaaacgaaagcgca

SEQ ID NO: 632 - RNA, 21 nt, Artificial Sequence
  source: /note="Description of Artificial Sequence: Synthetic oligonucleotide"
aaagugagugaccugcuuuua

SEQ ID NO: 633 - RNA, 21 nt, Artificial Sequence
  source: /note="Description of Artificial Sequence: Synthetic oligonucleotide"
aaaaacacagacucgcguuga

SEQ ID NO: 634 - RNA, 21 nt, Artificial Sequence
  source: /note="Description of Artificial Sequence: Synthetic oligonucleotide"
auuuguuuguacaagauccga

SEQ ID NO: 635 - RNA, 21 nt, Artificial Sequence
  source: /note="Description of Artificial Sequence: Synthetic oligonucleotide"
uuccccaaaucacuguggaua

SEQ ID NO: 636 - RNA, 21 nt, Artificial Sequence
  source: /note="Description of Artificial Sequence: Synthetic oligonucleotide"
auuaacaucacgucuuuguca

SEQ ID NO: 637 - RNA, 21 nt, Artificial Sequence
  source: /note="Description of Artificial Sequence: Synthetic oligonucleotide"
cgucuuugucucuagugcaga

SEQ ID NO: 638 - RNA, 21 nt, Artificial Sequence
  source: /note="Description of Artificial Sequence: Synthetic oligonucleotide"
aaaacacagacucgcguugca

SEQ ID NO: 639 - RNA, 21 nt, Artificial Sequence
  source: /note="Description of Artificial Sequence: Synthetic oligonucleotide"
ugcaaaaacacagacucgcga

SEQ ID NO: 640 - RNA, 21 nt, Artificial Sequence
  source: /note="Description of Artificial Sequence: Synthetic oligonucleotide"
aacacagacucgcguugcaaa

SEQ ID NO: 641 - RNA, 21 nt, Artificial Sequence
  source: /note="Description of Artificial Sequence: Synthetic oligonucleotide"
cuugcagaugugacaagccga

SEQ ID NO: 642 - RNA, 21 nt, Artificial Sequence
  source: /note="Description of Artificial Sequence: Synthetic oligonucleotide"
uuuauccguaauaauugugga

SEQ ID NO: 643 - RNA, 21 nt, Artificial Sequence
  source: /note="Description of Artificial Sequence: Synthetic oligonucleotide"
gcaaaaacacagacucgcgua

SEQ ID NO: 644 - RNA, 21 nt, Artificial Sequence
  source: /note="Description of Artificial Sequence: Synthetic oligonucleotide"
guuuauccguaauaauuguga

SEQ ID NO: 645 - RNA, 21 nt, Artificial Sequence
  source: /note="Description of Artificial Sequence: Synthetic oligonucleotide"
gggcaaaaacgaaagcgcaaa

SEQ ID NO: 646 - RNA, 21 nt, Artificial Sequence
  source: /note="Description of Artificial Sequence: Synthetic oligonucleotide"
uuauccguaauaauuguggga

SEQ ID NO: 647 - RNA, 23 nt, Artificial Sequence
  source: /note="Description of Artificial Sequence: Synthetic oligonucleotide"
uaucgaucguucuguaucagucu

SEQ ID NO: 648 - RNA, 23 nt, Artificial Sequence
  source: /note="Description of Artificial Sequence: Synthetic oligonucleotide"
uaucguucuguaucagucuuucc

SEQ ID NO: 649 - RNA, 23 nt, Artificial Sequence
  source: /note="Description of Artificial Sequence: Synthetic oligonucleotide"
ucguauauaaaacacuuucucuu

SEQ ID NO: 650 - RNA, 23 nt, Artificial Sequence
  source: /note="Description of Artificial Sequence: Synthetic oligonucleotide"
ucgaucguucuguaucagucuuu

SEQ ID NO: 651 - RNA, 23 nt, Artificial Sequence
  source: /note="Description of Artificial Sequence: Synthetic oligonucleotide"
uauacaucucauaaauaguugaa

SEQ ID NO: 652 - RNA, 23 nt, Artificial Sequence
  source: /note="Description of Artificial Sequence: Synthetic oligonucleotide"
ugaucguucuguaucagucuuuc

SEQ ID NO: 653 - RNA, 23 nt, Artificial Sequence
  source: /note="Description of Artificial Sequence: Synthetic oligonucleotide"
ucuguaucgaucguucuguauca

SEQ ID NO: 654 - RNA, 23 nt, Artificial Sequence
  source: /note="Description of Artificial Sequence: Synthetic oligonucleotide"
uccaauaacauuagcacuguuaa

SEQ ID NO: 655 - RNA, 23 nt, Artificial Sequence
  source: /note="Description of Artificial Sequence: Synthetic oligonucleotide"
ugacaccaauaacauuagcacug

SEQ ID NO: 656 - RNA, 23 nt, Artificial Sequence
  source: /note="Description of Artificial Sequence: Synthetic oligonucleotide"
ugauacaucucauaaauaguuga

SEQ ID NO: 657 - RNA, 23 nt, Artificial Sequence
  source: /note="Description of Artificial Sequence: Synthetic oligonucleotide"
ucuggauuaaggacuguucuguc

SEQ ID NO: 658 - RNA, 23 nt, Artificial Sequence
  source: /note="Description of Artificial Sequence: Synthetic oligonucleotide"
uucgaucguucuguaucagucuu

SEQ ID NO: 659 - RNA, 23 nt, Artificial Sequence
  source: /note="Description of Artificial Sequence: Synthetic oligonucleotide"
uauucacauuuguugugcuguag

SEQ ID NO: 660 - RNA, 23 nt, Artificial Sequence
  source: /note="Description of Artificial Sequence: Synthetic oligonucleotide"
ucagaauagcaaugucuauuuua

SEQ ID NO: 661 - RNA, 23 nt, Artificial Sequence
  source: /note="Description of Artificial Sequence: Synthetic oligonucleotide"
uauccagugaagacaccaauaac

SEQ ID NO: 662 - RNA, 23 nt, Artificial Sequence
  source: /note="Description of Artificial Sequence: Synthetic oligonucleotide"
uuaucgaucguucuguaucaguc

SEQ ID NO: 663 - RNA, 23 nt, Artificial Sequence
  source: /note="Description of Artificial Sequence: Synthetic oligonucleotide"
uaccgguacaaauaagagagcaa

SEQ ID NO: 664 - RNA, 23 nt, Artificial Sequence
  source: /note="Description of Artificial Sequence: Synthetic oligonucleotide"
uaacuagugguuucaauggugug

SEQ ID NO: 665 - RNA, 23 nt, Artificial Sequence
  source: /note="Description of Artificial Sequence: Synthetic oligonucleotide"
uuucguuuaacucaagcugccuc

SEQ ID NO: 666 - RNA, 23 nt, Artificial Sequence
  source: /note="Description of Artificial Sequence: Synthetic oligonucleotide"
ucugcaaguacguucguuuaacu

SEQ ID NO: 667 - RNA, 23 nt, Artificial Sequence
  source: /note="Description of Artificial Sequence: Synthetic oligonucleotide"
uaagcuagugacugucaccgauc

SEQ ID NO: 668 - RNA, 23 nt, Artificial Sequence
  source: /note="Description of Artificial Sequence: Synthetic oligonucleotide"
ugcaaguacguucguuuaacuca

SEQ ID NO: 669 - RNA, 23 nt, Artificial Sequence
  source: /note="Description of Artificial Sequence: Synthetic oligonucleotide"
uguucguuuaacucaagcugccu

SEQ ID NO: 670 - RNA, 23 nt, Artificial Sequence
  source: /note="Description of Artificial Sequence: Synthetic oligonucleotide"
uacaccaauaacauuagcacugu

SEQ ID NO: 671 - RNA, 23 nt, Artificial Sequence
  source: /note="Description of Artificial Sequence: Synthetic oligonucleotide"
uccaugaacuucaccacuucgug

SEQ ID NO: 672 - RNA, 23 nt, Artificial Sequence
  source: /note="Description of Artificial Sequence: Synthetic oligonucleotide"
ucuuguacaaacaaaugcuuucu

SEQ ID NO: 673 - RNA, 23 nt, Artificial Sequence
  source: /note="Description of Artificial Sequence: Synthetic oligonucleotide"
uuuucaauggugugaggacauag

SEQ ID NO: 674 - RNA, 23 nt, Artificial Sequence
  source: /note="Description of Artificial Sequence: Synthetic oligonucleotide"
uaaguacguucguuuaacucaag

SEQ ID NO: 675 - RNA, 23 nt, Artificial Sequence
  source: /note="Description of Artificial Sequence: Synthetic oligonucleotide"
uacuagugguuucaaugguguga

SEQ ID NO: 676 - RNA, 23 nt, Artificial Sequence
  source: /note="Description of Artificial Sequence: Synthetic oligonucleotide"
uaacgcgagucuguguuuuugca

SEQ ID NO: 677 - RNA, 23 nt, Artificial Sequence
  source: /note="Description of Artificial Sequence: Synthetic oligonucleotide"
uguuucaauggugugaggacaua

SEQ ID NO: 678 - RNA, 23 nt, Artificial Sequence
  source: /note="Description of Artificial Sequence: Synthetic oligonucleotide"
ucguucguuuaacucaagcugcc

SEQ ID NO: 679 - RNA, 23 nt, Artificial Sequence
  source: /note="Description of Artificial Sequence: Synthetic oligonucleotide"
uuacggauaaacaguagcaccaa

SEQ ID NO: 680 - RNA, 23 nt, Artificial Sequence
  source: /note="Description of Artificial Sequence: Synthetic oligonucleotide"
ucgguacaaauaagagagcaaga

SEQ ID NO: 681 - RNA, 23 nt, Artificial Sequence
  source: /note="Description of Artificial Sequence: Synthetic oligonucleotide"
uucggugauuuagcagcaagaaa

SEQ ID NO: 682 - RNA, 23 nt, Artificial Sequence
  source: /note="Description of Artificial Sequence: Synthetic oligonucleotide"
ugggauauuaaauaaguaccgua

SEQ ID NO: 683 - RNA, 23 nt, Artificial Sequence
  source: /note="Description of Artificial Sequence: Synthetic oligonucleotide"
uagaauagcaaugucuauuuuau

SEQ ID NO: 684 - RNA, 23 nt, Artificial Sequence
  source: /note="Description of Artificial Sequence: Synthetic oligonucleotide"
uccagaaguuggacgaaaaguuu

SEQ ID NO: 685 - RNA, 23 nt, Artificial Sequence
  source: /note="Description of Artificial Sequence: Synthetic oligonucleotide"
ucggauaaacaguagcaccaaua

SEQ ID NO: 686 - RNA, 23 nt, Artificial Sequence
  source: /note="Description of Artificial Sequence: Synthetic oligonucleotide"
uccagugaagacaccaauaacau

SEQ ID NO: 687 - RNA, 23 nt, Artificial Sequence
  source: /note="Description of Artificial Sequence: Synthetic oligonucleotide"
ucagcccagaaguuggacgaaaa

SEQ ID NO: 688 - RNA, 23 nt, Artificial Sequence
  source: /note="Description of Artificial Sequence: Synthetic oligonucleotide"
ucggugauuuagcagcaagaaaa

SEQ ID NO: 689 - RNA, 23 nt, Artificial Sequence
  source: /note="Description of Artificial Sequence: Synthetic oligonucleotide"
uagggauauuaaauaaguaccgu

SEQ ID NO: 690 - RNA, 23 nt, Artificial Sequence
  source: /note="Description of Artificial Sequence: Synthetic oligonucleotide"
ucaaagacgugauguuaauaucu

SEQ ID NO: 691 - RNA, 23 nt, Artificial Sequence
  source: /note="Description of Artificial Sequence: Synthetic oligonucleotide"
ucguuuaacucaagcugccucgc

SEQ ID NO: 692 - RNA, 23 nt, Artificial Sequence
  source: /note="Description of Artificial Sequence: Synthetic oligonucleotide"
uuuacggauaaacaguagcacca

SEQ ID NO: 693 - RNA, 23 nt, Artificial Sequence
  source: /note="Description of Artificial Sequence: Synthetic oligonucleotide"
uucguuuaacucaagcugccucg

SEQ ID NO: 694 - RNA, 23 nt, Artificial Sequence
  source: /note="Description of Artificial Sequence: Synthetic oligonucleotide"
uacggauaaacaguagcaccaau

SEQ ID NO: 695 - RNA, 23 nt, Artificial Sequence
  source: /note="Description of Artificial Sequence: Synthetic oligonucleotide"
ucgcuuucguuuuugccccuuuc

SEQ ID NO: 696 - RNA, 23 nt, Artificial Sequence
  source: /note="Description of Artificial Sequence: Synthetic oligonucleotide"
ucaagauaagcuagugacuguca

SEQ ID NO: 697 - RNA, 23 nt, Artificial Sequence
  source: /note="Description of Artificial Sequence: Synthetic oligonucleotide"
uggauauuaaauaaguaccguau

SEQ ID NO: 698 - RNA, 23 nt, Artificial Sequence
  source: /note="Description of Artificial Sequence: Synthetic oligonucleotide"
ucaaguacguucguuuaacucaa

SEQ ID NO: 699 - RNA, 23 nt, Artificial Sequence
  source: /note="Description of Artificial Sequence: Synthetic oligonucleotide"
ucagugaagacaccaauaacauu

SEQ ID NO: 700 - RNA, 23 nt, Artificial Sequence
  source: /note="Description of Artificial Sequence: Synthetic oligonucleotide"
ugauuaaggacuguucugucgau

SEQ ID NO: 701 - RNA, 23 nt, Artificial Sequence
  source: /note="Description of Artificial Sequence: Synthetic oligonucleotide"
uccuuuccucgaacugauuuuuu

SEQ ID NO: 702 - RNA, 23 nt, Artificial Sequence
  source: /note="Description of Artificial Sequence: Synthetic oligonucleotide"
uauggcgaauccaauuccaagag

SEQ ID NO: 703 - RNA, 23 nt, Artificial Sequence
  source: /note="Description of Artificial Sequence: Synthetic oligonucleotide"
ucaacaaugugucucuucucuuc

SEQ ID NO: 704 - RNA, 23 nt, Artificial Sequence
  source: /note="Description of Artificial Sequence: Synthetic oligonucleotide"
uugcacuagagacaaagacguga

SEQ ID NO: 705 - RNA, 23 nt, Artificial Sequence
  source: /note="Description of Artificial Sequence: Synthetic oligonucleotide"
uagauaagcuagugacugucacc

SEQ ID NO: 706 - RNA, 23 nt, Artificial Sequence
  source: /note="Description of Artificial Sequence: Synthetic oligonucleotide"
uaguacguucguuuaacucaagc

SEQ ID NO: 707 - RNA, 23 nt, Artificial Sequence
  source: /note="Description of Artificial Sequence: Synthetic oligonucleotide"
uuuguacaaacaaaugcuuucuc

SEQ ID NO: 708 - RNA, 23 nt, Artificial Sequence
  source: /note="Description of Artificial Sequence: Synthetic oligonucleotide"
ucgcauaaucugcauggugaugu

SEQ ID NO: 709 - RNA, 23 nt, Artificial Sequence
  source: /note="Description of Artificial Sequence: Synthetic oligonucleotide"
uuccgcauaaucugcauggugau

SEQ ID NO: 710 - RNA, 23 nt, Artificial Sequence
  source: /note="Description of Artificial Sequence: Synthetic oligonucleotide"
uguacguucguuuaacucaagcu

SEQ ID NO: 711 - RNA, 23 nt, Artificial Sequence
  source: /note="Description of Artificial Sequence: Synthetic oligonucleotide"
uucggcuugucacaucugcaagu

SEQ ID NO: 712 - RNA, 23 nt, Artificial Sequence
  source: /note="Description of Artificial Sequence: Synthetic oligonucleotide"
uagauacaucucauaaauaguug

SEQ ID NO: 713 - RNA, 23 nt, Artificial Sequence
  source: /note="Description of Artificial Sequence: Synthetic oligonucleotide"
uccaagaauacugaaaaaaaacc

SEQ ID NO: 714 - RNA, 23 nt, Artificial Sequence
  source: /note="Description of Artificial Sequence: Synthetic oligonucleotide"
uauaaguaccguauauaaaacac

SEQ ID NO: 715 - RNA, 23 nt, Artificial Sequence
  source: /note="Description of Artificial Sequence: Synthetic oligonucleotide"
uaccguauauaaaacacuuucuc

SEQ ID NO: 716 - RNA, 23 nt, Artificial Sequence
  source: /note="Description of Artificial Sequence: Synthetic oligonucleotide"
ucagucaaauacauccagugaag

SEQ ID NO: 717 - RNA, 23 nt, Artificial Sequence
  source: /note="Description of Artificial Sequence: Synthetic oligonucleotide"
uuacguucguuuaacucaagcug

SEQ ID NO: 718 - RNA, 23 nt, Artificial Sequence
  source: /note="Description of Artificial Sequence: Synthetic oligonucleotide"
uaaaguucaugguuucggaggcc

SEQ ID NO: 719 - RNA, 23 nt, Artificial Sequence
  source: /note="Description of Artificial Sequence: Synthetic oligonucleotide"
ucuuuccucgaacugauuuuuuu

SEQ ID NO: 720 - RNA, 23 nt, Artificial Sequence
  source: /note="Description of Artificial Sequence: Synthetic oligonucleotide"
uauuuaguauguagaauucucua

SEQ ID NO: 721 - RNA, 23 nt, Artificial Sequence
  source: /note="Description of Artificial Sequence: Synthetic oligonucleotide"
uagguuugauccgcauaaucugc

SEQ ID NO: 722 - RNA, 23 nt, Artificial Sequence
  source: /note="Description of Artificial Sequence: Synthetic oligonucleotide"
ucccuuuccucgaacugauuuuu

SEQ ID NO: 723 - RNA, 23 nt, Artificial Sequence
  source: /note="Description of Artificial Sequence: Synthetic oligonucleotide"
ugaucuuguacaaacaaaugcuu

SEQ ID NO: 724 - RNA, 23 nt, Artificial Sequence
  source: /note="Description of Artificial Sequence: Synthetic oligonucleotide"
uaugaacuucaccacuucgugau

SEQ ID NO: 725 - RNA, 23 nt, Artificial Sequence
  source: /note="Description of Artificial Sequence: Synthetic oligonucleotide"
ucauuucagguuucuggauuaag

SEQ ID NO: 726 - RNA, 23 nt, Artificial Sequence
  source: /note="Description of Artificial Sequence: Synthetic oligonucleotide"
ucacaggauggcuugaagaugua

SEQ ID NO: 727 - RNA, 23 nt, Artificial Sequence
  source: /note="Description of Artificial Sequence: Synthetic oligonucleotide"
uauuacggauaaacaguagcacc

SEQ ID NO: 728 - RNA, 23 nt, Artificial Sequence
  source: /note="Description of Artificial Sequence: Synthetic oligonucleotide"
ugcucggugauuuagcagcaaga

SEQ ID NO: 729 - RNA, 23 nt, Artificial Sequence
  source: /note="Description of Artificial Sequence: Synthetic oligonucleotide"
uaaagacgugauguuaauaucuu

SEQ ID NO: 730 - RNA, 23 nt, Artificial Sequence
  source: /note="Description of Artificial Sequence: Synthetic oligonucleotide"
ugcgagucuguguuuuugcagga

SEQ ID NO: 731 - RNA, 23 nt, Artificial Sequence
  source: /note="Description of Artificial Sequence: Synthetic oligonucleotide"
ucucggugauuuagcagcaagaa

SEQ ID NO: 732 - RNA, 23 nt, Artificial Sequence
  source: /note="Description of Artificial Sequence: Synthetic oligonucleotide"
uccguauauaaaacacuuucucu

SEQ ID NO: 733 - RNA, 23 nt, Artificial Sequence
  source: /note="Description of Artificial Sequence: Synthetic oligonucleotide"
uauaaucugcauggugauguugg

SEQ ID NO: 734 - RNA, 23 nt, Artificial Sequence
  source: /note="Description of Artificial Sequence: Synthetic oligonucleotide"
uggaacauuuacacgucugcgga

SEQ ID NO: 735 - RNA, 23 nt, Artificial Sequence
  source: /note="Description of Artificial Sequence: Synthetic oligonucleotide"
uacguucguuuaacucaagcugc

SEQ ID NO: 736 - RNA, 23 nt, Artificial Sequence
  source: /note="Description of Artificial Sequence: Synthetic oligonucleotide"
uuggacgaaaaguuucagugcga

SEQ ID NO: 737 - RNA, 23 nt, Artificial Sequence
  source: /note="Description of Artificial Sequence: Synthetic oligonucleotide"
ugagauuuaguauguagaauucu

SEQ ID NO: 738 - RNA, 23 nt, Artificial Sequence
  source: /note="Description of Artificial Sequence: Synthetic oligonucleotide"
ugaacauuuacacgucugcggau

SEQ ID NO: 739 - RNA, 23 nt, Artificial Sequence
  source: /note="Description of Artificial Sequence: Synthetic oligonucleotide"
uaacauuuacacgucugcggauc

SEQ ID NO: 740 - RNA, 23 nt, Artificial Sequence
  source: /note="Description of Artificial Sequence: Synthetic oligonucleotide"
uggacgaaaaguuucagugcgac

SEQ ID NO: 741 - RNA, 23 nt, Artificial Sequence
  source: /note="Description of Artificial Sequence: Synthetic oligonucleotide"
ucgaauccaauuccaagagggac

SEQ ID NO: 742 - RNA, 23 nt, Artificial Sequence
  source: /note="Description of Artificial Sequence: Synthetic oligonucleotide"
ucaggaacauuuacacgucugcg

SEQ ID NO: 743 - RNA, 23 nt, Artificial Sequence
  source: /note="Description of Artificial Sequence: Synthetic oligonucleotide"
uacaucugcaaguacguucguuu

SEQ ID NO: 744 - RNA, 23 nt, Artificial Sequence
  source: /note="Description of Artificial Sequence: Synthetic oligonucleotide"
uacauuuacacgucugcggaucu

SEQ ID NO: 745 - RNA, 23 nt, Artificial Sequence
  source: /note="Description of Artificial Sequence: Synthetic oligonucleotide"
uaccacuucgugaugauucugcc

SEQ ID NO: 746 - RNA, 23 nt, Artificial Sequence
  source: /note="Description of Artificial Sequence: Synthetic oligonucleotide"
ucgagucuguguuuuugcaggaa

SEQ ID NO: 747 - RNA, 23 nt, Artificial Sequence
  source: /note="Description of Artificial Sequence: Synthetic oligonucleotide"
uccaaagcacagcaauguccuga

SEQ ID NO: 748 - RNA, 23 nt, Artificial Sequence
  source: /note="Description of Artificial Sequence: Synthetic oligonucleotide"
uacuucgugaugauucugcccuc

SEQ ID NO: 749 - RNA, 23 nt, Artificial Sequence
  source: /note="Description of Artificial Sequence: Synthetic oligonucleotide"
uauagacauccaugaacuucacc

SEQ ID NO: 750 - RNA, 23 nt, Artificial Sequence
  source: /note="Description of Artificial Sequence: Synthetic oligonucleotide"
ucgaaaaguuucagugcgacgcc

SEQ ID NO: 751 - RNA, 23 nt, Artificial Sequence
  source: /note="Description of Artificial Sequence: Synthetic oligonucleotide"
uccucgaacugauuuuuuuucuu

SEQ ID NO: 752 - RNA, 23 nt, Artificial Sequence
  source: /note="Description of Artificial Sequence: Synthetic oligonucleotide"
ucauccagugaagacaccaauaa

SEQ ID NO: 753 - RNA, 23 nt, Artificial Sequence
  source: /note="Description of Artificial Sequence: Synthetic oligonucleotide"
uauuuacacgucugcggaucuug

SEQ ID NO: 754 - RNA, 23 nt, Artificial Sequence
  source: /note="Description of Artificial Sequence: Synthetic oligonucleotide"
ucauuuacacgucugcggaucuu

SEQ ID NO: 755 - RNA, 23 nt, Artificial Sequence
  source: /note="Description of Artificial Sequence: Synthetic oligonucleotide"
uugcggaucuuguacaaacaaau

SEQ ID NO: 756 - RNA, 23 nt, Artificial Sequence
  source: /note="Description of Artificial Sequence: Synthetic oligonucleotide"
ucccaacucaaguccacagcagu

SEQ ID NO: 757 - RNA, 23 nt, Artificial Sequence
  source: /note="Description of Artificial Sequence: Synthetic oligonucleotide"
ugcacuagagacaaagacgugau

SEQ ID NO: 758 - RNA, 23 nt, Artificial Sequence
  source: /note="Description of Artificial Sequence: Synthetic oligonucleotide"
uaccaagaauacugaaaaaaaac

SEQ ID NO: 759 - RNA, 23 nt, Artificial Sequence
  source: /note="Description of Artificial Sequence: Synthetic oligonucleotide"
uugaauaucaaauuccagcaccg

SEQ ID NO: 760 - RNA, 23 nt, Artificial Sequence
  source: /note="Description of Artificial Sequence: Synthetic oligonucleotide"
uagacaaagacgugauguuaaua

SEQ ID NO: 761 - RNA, 23 nt, Artificial Sequence
  source: /note="Description of Artificial Sequence: Synthetic oligonucleotide"
ugcgcuuucguuuuugccccuuu

SEQ ID NO: 762 - RNA, 23 nt, Artificial Sequence
  source: /note="Description of Artificial Sequence: Synthetic oligonucleotide"
uaaaagcaggucacucacuuugc

SEQ ID NO: 763 - RNA, 23 nt, Artificial Sequence
  source: /note="Description of Artificial Sequence: Synthetic oligonucleotide"
ucaacgcgagucuguguuuuugc

SEQ ID NO: 764 - RNA, 23 nt, Artificial Sequence
  source: /note="Description of Artificial Sequence: Synthetic oligonucleotide"
ucggaucuuguacaaacaaaugc

SEQ ID NO: 765 - RNA, 23 nt, Artificial Sequence
  source: /note="Description of Artificial Sequence: Synthetic oligonucleotide"
uauccacagugauuuggggaagu

SEQ ID NO: 766 - RNA, 23 nt, Artificial Sequence
  source: /note="Description of Artificial Sequence: Synthetic oligonucleotide"
ugacaaagacgugauguuaauau

SEQ ID NO: 767 - RNA, 23 nt, Artificial Sequence
  source: /note="Description of Artificial Sequence: Synthetic oligonucleotide"
ucugcacuagagacaaagacgug

SEQ ID NO: 768 - RNA, 23 nt, Artificial Sequence
  source: /note="Description of Artificial Sequence: Synthetic oligonucleotide"
ugcaacgcgagucuguguuuuug

SEQ ID NO: 769 - RNA, 23 nt, Artificial Sequence
  source: /note="Description of Artificial Sequence: Synthetic oligonucleotide"
ucgcgagucuguguuuuugcagg

SEQ ID NO: 770 - RNA, 23 nt, Artificial Sequence
  source: /note="Description of Artificial Sequence: Synthetic oligonucleotide"
uuugcaacgcgagucuguguuuu

SEQ ID NO: 771 - RNA, 23 nt, Artificial Sequence
  source: /note="Description of Artificial Sequence: Synthetic oligonucleotide"
ucggcuugucacaucugcaagua

SEQ ID NO: 772 - RNA, 23 nt, Artificial Sequence
  source: /note="Description of Artificial Sequence: Synthetic oligonucleotide"
uccacaauuauuacggauaaaca

SEQ ID NO: 773 - RNA, 23 nt, Artificial Sequence
  source: /note="Description of Artificial Sequence: Synthetic oligonucleotide"
uacgcgagucuguguuuuugcag

SEQ ID NO: 774 - RNA, 23 nt, Artificial Sequence
  source: /note="Description of Artificial Sequence: Synthetic oligonucleotide"
ucacaauuauuacggauaaacag

SEQ ID NO: 775 - RNA, 23 nt, Artificial Sequence
  source: /note="Description of Artificial Sequence: Synthetic oligonucleotide"
uuugcgcuuucguuuuugccccu

SEQ ID NO: 776 - RNA, 23 nt, Artificial Sequence
  source: /note="Description of Artificial Sequence: Synthetic oligonucleotide"
ucccacaauuauuacggauaaac

SEQ ID NO: 777 - RNA, 21 nt, Artificial Sequence
  source: /note="Description of Artificial Sequence: Synthetic oligonucleotide"
acugauacagaacgaucgaua

SEQ ID NO: 778 - RNA, 21 nt, Artificial Sequence
  source: /note="Description of Artificial Sequence: Synthetic oligonucleotide"
aaagacugauacagaacgaua

SEQ ID NO: 779 - RNA, 21 nt, Artificial Sequence
  source: /note="Description of Artificial Sequence: Synthetic oligonucleotide"
gagaaaguguuuuauauacga

SEQ ID NO: 780 - RNA, 21 nt, Artificial Sequence
  source: /note="Description of Artificial Sequence: Synthetic oligonucleotide"
agacugauacagaacgaucga

SEQ ID NO: 781 - RNA, 21 nt, Artificial Sequence
  source: /note="Description of Artificial Sequence: Synthetic oligonucleotide"
caacuauuuaugagauguaua

SEQ ID NO: 782 - RNA, 21 nt, Artificial Sequence
  source: /note="Description of Artificial Sequence: Synthetic oligonucleotide"
aagacugauacagaacgauca

SEQ ID NO: 783 - RNA, 21 nt, Artificial Sequence
  source: /note="Description of Artificial Sequence: Synthetic oligonucleotide"
auacagaacgaucgauacaga

SEQ ID NO: 784 - RNA, 21 nt, Artificial Sequence
  source: /note="Description of Artificial Sequence: Synthetic oligonucleotide"
aacagugcuaauguuauugga

SEQ ID NO: 785 - RNA, 21 nt, Artificial Sequence
  source: /note="Description of Artificial Sequence: Synthetic oligonucleotide"
gugcuaauguuauugguguca

SEQ ID NO: 786 - RNA, 21 nt, Artificial Sequence
  source: /note="Description of Artificial Sequence: Synthetic oligonucleotide"
aacuauuuaugagauguauca

SEQ ID NO: 787 - RNA, 21 nt, Artificial Sequence
  source: /note="Description of Artificial Sequence: Synthetic oligonucleotide"
cagaacaguccuuaauccaga

SEQ ID NO: 788 - RNA, 21 nt, Artificial Sequence
  source: /note="Description of Artificial Sequence: Synthetic oligonucleotide"
gacugauacagaacgaucgaa

SEQ ID NO: 789 - RNA, 21 nt, Artificial Sequence
  source: /note="Description of Artificial Sequence: Synthetic oligonucleotide"
acagcacaacaaaugugaaua

SEQ ID NO: 790 - RNA, 21 nt, Artificial Sequence
  source: /note="Description of Artificial Sequence: Synthetic oligonucleotide"
aaauagacauugcuauucuga

SEQ ID NO: 791 - RNA, 21 nt, Artificial Sequence
  source: /note="Description of Artificial Sequence: Synthetic oligonucleotide"
uauuggugucuucacuggaua

SEQ ID NO: 792 - RNA, 21 nt, Artificial Sequence
  source: /note="Description of Artificial Sequence: Synthetic oligonucleotide"
cugauacagaacgaucgauaa

SEQ ID NO: 793 - RNA, 21 nt, Artificial Sequence
  source: /note="Description of Artificial Sequence: Synthetic oligonucleotide"
gcucucuuauuuguaccggua

SEQ ID NO: 794 - RNA, 21 nt, Artificial Sequence
  source: /note="Description of Artificial Sequence: Synthetic oligonucleotide"
caccauugaaaccacuaguua

SEQ ID NO: 795 - RNA, 21 nt, Artificial Sequence
  source: /note="Description of Artificial Sequence: Synthetic oligonucleotide"
ggcagcuugaguuaaacgaaa

SEQ ID NO: 796 - RNA, 21 nt, Artificial Sequence
  source: /note="Description of Artificial Sequence: Synthetic oligonucleotide"
uuaaacgaacguacuugcaga

SEQ ID NO: 797 - RNA, 21 nt, Artificial Sequence
  source: /note="Description of Artificial Sequence: Synthetic oligonucleotide"
ucggugacagucacuagcuua

SEQ ID NO: 798 - RNA, 21 nt, Artificial Sequence
  source: /note="Description of Artificial Sequence: Synthetic oligonucleotide"
aguuaaacgaacguacuugca

SEQ ID NO: 799 - RNA, 21 nt, Artificial Sequence
  source: /note="Description of Artificial Sequence: Synthetic oligonucleotide"
gcagcuugaguuaaacgaaca

SEQ ID NO: 800 - RNA, 21 nt, Artificial Sequence
  source: /note="Description of Artificial Sequence: Synthetic oligonucleotide"
agugcuaauguuauuggugua

SEQ ID NO: 801 - RNA, 21 nt, Artificial Sequence
  source: /note="Description of Artificial Sequence: Synthetic oligonucleotide"
cgaaguggugaaguucaugga

SEQ ID NO: 802 - RNA, 21 nt, Artificial Sequence
  source: /note="Description of Artificial Sequence: Synthetic oligonucleotide"
aaagcauuuguuuguacaaga

SEQ ID NO: 803 - RNA, 21 nt, Artificial Sequence
  source: /note="Description of Artificial Sequence: Synthetic oligonucleotide"
auguccucacaccauugaaaa

SEQ ID NO: 804 - RNA, 21 nt, Artificial Sequence
  source: /note="Description of Artificial Sequence: Synthetic oligonucleotide"
ugaguuaaacgaacguacuua

SEQ ID NO: 805 - RNA, 21 nt, Artificial Sequence
  source: /note="Description of Artificial Sequence: Synthetic oligonucleotide"
acaccauugaaaccacuagua

SEQ ID NO: 806 - RNA, 21 nt, Artificial Sequence
  source: /note="Description of Artificial Sequence: Synthetic oligonucleotide"
caaaaacacagacucgcguua

SEQ ID NO: 807 - RNA, 21 nt, Artificial Sequence
  source: /note="Description of Artificial Sequence: Synthetic oligonucleotide"
uguccucacaccauugaaaca

SEQ ID NO: 808 - RNA, 21 nt, Artificial Sequence
  source: /note="Description of Artificial Sequence: Synthetic oligonucleotide"
cagcuugaguuaaacgaacga

SEQ ID NO: 809 - RNA, 21 nt, Artificial Sequence
  source: /note="Description of Artificial Sequence: Synthetic oligonucleotide"
ggugcuacuguuuauccguaa

SEQ ID NO: 810 - RNA, 21 nt, Artificial Sequence
  source: /note="Description of Artificial Sequence: Synthetic oligonucleotide"
uugcucucuuauuuguaccga

SEQ ID NO: 811 - RNA, 21 nt, Artificial Sequence
  source: /note="Description of Artificial Sequence: Synthetic oligonucleotide"
ucuugcugcuaaaucaccgaa

SEQ ID NO: 812 - RNA, 21 nt, Artificial Sequence
  source: /note="Description of Artificial Sequence: Synthetic oligonucleotide"
cgguacuuauuuaauauccca

SEQ ID NO: 813 - RNA, 21 nt, Artificial Sequence
  source: /note="Description of Artificial Sequence: Synthetic oligonucleotide"
aaaauagacauugcuauucua

SEQ ID NO: 814 - RNA, 21 nt, Artificial Sequence
  source: /note="Description of Artificial Sequence: Synthetic oligonucleotide"
acuuuucguccaacuucugga

SEQ ID NO: 815 - RNA, 21 nt, Artificial Sequence
  source: /note="Description of Artificial Sequence: Synthetic oligonucleotide"
uuggugcuacuguuuauccga

SEQ ID NO: 816 - RNA, 21 nt, Artificial Sequence
  source: /note="Description of Artificial Sequence: Synthetic oligonucleotide"
guuauuggugucuucacugga

SEQ ID NO: 817 - RNA, 21 nt, Artificial Sequence
  source: /note="Description of Artificial Sequence: Synthetic oligonucleotide"
uucguccaacuucugggcuga

SEQ ID NO: 818 - RNA, 21 nt, Artificial Sequence
  source: /note="Description of Artificial Sequence: Synthetic oligonucleotide"
uucuugcugcuaaaucaccga

SEQ ID NO: 819 - RNA, 21 nt, Artificial Sequence
  source: /note="Description of Artificial Sequence: Synthetic oligonucleotide"
gguacuuauuuaauaucccua

SEQ ID NO: 820 - RNA, 21 nt, Artificial Sequence
  source: /note="Description of Artificial Sequence: Synthetic oligonucleotide"
auauuaacaucacgucuuuga

SEQ ID NO: 821 - RNA, 21 nt, Artificial Sequence
  source: /note="Description of Artificial Sequence: Synthetic oligonucleotide"
gaggcagcuugaguuaaacga

SEQ ID NO: 822 - RNA, 21 nt, Artificial Sequence
  source: /note="Description of Artificial Sequence: Synthetic oligonucleotide"
gugcuacuguuuauccguaaa

SEQ ID NO: 823 - RNA, 21 nt, Artificial Sequence
  source: /note="Description of Artificial Sequence: Synthetic oligonucleotide"
aggcagcuugaguuaaacgaa

SEQ ID NO: 824 - RNA, 21 nt, Artificial Sequence
  source: /note="Description of Artificial Sequence: Synthetic oligonucleotide"
uggugcuacuguuuauccgua

SEQ ID NO: 825 - RNA, 21 nt, Artificial Sequence
  source: /note="Description of Artificial Sequence: Synthetic oligonucleotide"
aaggggcaaaaacgaaagcga

SEQ ID NO: 826 - RNA, 21 nt, Artificial Sequence
  source: /note="Description of Artificial Sequence: Synthetic oligonucleotide"
acagucacuagcuuaucuuga

SEQ ID NO: 827 - RNA, 21 nt, Artificial Sequence
  source: /note="Description of Artificial Sequence: Synthetic oligonucleotide"
acgguacuuauuuaauaucca

SEQ ID NO: 828 - RNA, 21 nt, Artificial Sequence
  source: /note="Description of Artificial Sequence: Synthetic oligonucleotide"
gaguuaaacgaacguacuuga

SEQ ID NO: 829 - RNA, 21 nt, Artificial Sequence
  source: /note="Description of Artificial Sequence: Synthetic oligonucleotide"
uguuauuggugucuucacuga

SEQ ID NO: 830 - RNA, 21 nt, Artificial Sequence
  source: /note="Description of Artificial Sequence: Synthetic oligonucleotide"
cgacagaacaguccuuaauca

SEQ ID NO: 831 - RNA, 21 nt, Artificial Sequence
  source: /note="Description of Artificial Sequence: Synthetic oligonucleotide"
aaaaucaguucgaggaaagga

SEQ ID NO: 832 - RNA, 21 nt, Artificial Sequence
  source: /note="Description of Artificial Sequence: Synthetic oligonucleotide"
cuuggaauuggauucgccaua

SEQ ID NO: 833 - RNA, 21 nt, Artificial Sequence
  source: /note="Description of Artificial Sequence: Synthetic oligonucleotide"
agagaagagacacauuguuga

SEQ ID NO: 834 - RNA, 21 nt, Artificial Sequence
  source: /note="Description of Artificial Sequence: Synthetic oligonucleotide"
acgucuuugucucuagugcaa

SEQ ID NO: 835 - RNA, 21 nt, Artificial Sequence
  source: /note="Description of Artificial Sequence: Synthetic oligonucleotide"
ugacagucacuagcuuaucua

SEQ ID NO: 836 - RNA, 21 nt, Artificial Sequence
  source: /note="Description of Artificial Sequence: Synthetic oligonucleotide"
uugaguuaaacgaacguacua

SEQ ID NO: 837 - RNA, 21 nt, Artificial Sequence
  source: /note="Description of Artificial Sequence: Synthetic oligonucleotide"
gaaagcauuuguuuguacaaa

SEQ ID NO: 838 - RNA, 21 nt, Artificial Sequence
  source: /note="Description of Artificial Sequence: Synthetic oligonucleotide"
aucaccaugcagauuaugcga

SEQ ID NO: 839 - RNA, 21 nt, Artificial Sequence
  source: /note="Description of Artificial Sequence: Synthetic oligonucleotide"
caccaugcagauuaugcggaa

SEQ ID NO: 840 - RNA, 21 nt, Artificial Sequence
  source: /note="Description of Artificial Sequence: Synthetic oligonucleotide"
cuugaguuaaacgaacguaca

SEQ ID NO: 841 - RNA, 21 nt, Artificial Sequence
  source: /note="Description of Artificial Sequence: Synthetic oligonucleotide"
uugcagaugugacaagccgaa

SEQ ID NO: 842 - RNA, 21 nt, Artificial Sequence
  source: /note="Description of Artificial Sequence: Synthetic oligonucleotide"
acuauuuaugagauguaucua

SEQ ID NO: 843 - RNA, 21 nt, Artificial Sequence
  source: /note="Description of Artificial Sequence: Synthetic oligonucleotide"
uuuuuuuucaguauucuugga

SEQ ID NO: 844 - RNA, 21 nt, Artificial Sequence
  source: /note="Description of Artificial Sequence: Synthetic oligonucleotide"
guuuuauauacgguacuuaua

SEQ ID NO: 845 - RNA, 21 nt, Artificial Sequence
  source: /note="Description of Artificial Sequence: Synthetic oligonucleotide"
gaaaguguuuuauauacggua

SEQ ID NO: 846 - RNA, 21 nt, Artificial Sequence
  source: /note="Description of Artificial Sequence: Synthetic oligonucleotide"
ucacuggauguauuugacuga

SEQ ID NO: 847 - RNA, 21 nt, Artificial Sequence
  source: /note="Description of Artificial Sequence: Synthetic oligonucleotide"
gcuugaguuaaacgaacguaa

SEQ ID NO: 848 - RNA, 21 nt, Artificial Sequence
  source: /note="Description of Artificial Sequence: Synthetic oligonucleotide"
ccuccgaaaccaugaacuuua

SEQ ID NO: 849 - RNA, 21 nt, Artificial Sequence
  source: /note="Description of Artificial Sequence: Synthetic oligonucleotide"
aaaaaucaguucgaggaaaga

SEQ ID NO: 850 - RNA, 21 nt, Artificial Sequence
  source: /note="Description of Artificial Sequence: Synthetic oligonucleotide"
gagaauucuacauacuaaaua

SEQ ID NO: 851 - RNA, 21 nt, Artificial Sequence
  source: /note="Description of Artificial Sequence: Synthetic oligonucleotide"
agauuaugcggaucaaaccua

SEQ ID NO: 852 - RNA, 21 nt, Artificial Sequence
  source: /note="Description of Artificial Sequence: Synthetic oligonucleotide"
aaaucaguucgaggaaaggga

SEQ ID NO: 853 - RNA, 21 nt, Artificial Sequence
  source: /note="Description of Artificial Sequence: Synthetic oligonucleotide"
gcauuuguuuguacaagauca

SEQ ID NO: 854 - RNA, 21 nt, Artificial Sequence
  source: /note="Description of Artificial Sequence: Synthetic oligonucleotide"
cacgaaguggugaaguucaua

SEQ ID NO: 855 - RNA, 21 nt, Artificial Sequence
  source: /note="Description of Artificial Sequence: Synthetic oligonucleotide"
uaauccagaaaccugaaauga

SEQ ID NO: 856 - RNA, 21 nt, Artificial Sequence
  source: /note="Description of Artificial Sequence: Synthetic oligonucleotide"
caucuucaagccauccuguga

SEQ ID NO: 857 - RNA, 21 nt, Artificial Sequence
  source: /note="Description of Artificial Sequence: Synthetic oligonucleotide"
ugcuacuguuuauccguaaua

SEQ ID NO: 858 - RNA, 21 nt, Artificial Sequence
  source: /note="Description of Artificial Sequence: Synthetic oligonucleotide"
uugcugcuaaaucaccgagca

SEQ ID NO: 859 - RNA, 21 nt, Artificial Sequence
  source: /note="Description of Artificial Sequence: Synthetic oligonucleotide"
gauauuaacaucacgucuuua

SEQ ID NO: 860 - RNA, 21 nt, Artificial Sequence
  source: /note="Description of Artificial Sequence: Synthetic oligonucleotide"
cugcaaaaacacagacucgca

SEQ ID NO: 861 - RNA, 21 nt, Artificial Sequence
  source: /note="Description of Artificial Sequence: Synthetic oligonucleotide"
cuugcugcuaaaucaccgaga

SEQ ID NO: 862 - RNA, 21 nt, Artificial Sequence
  source: /note="Description of Artificial Sequence: Synthetic oligonucleotide"
agaaaguguuuuauauacgga

SEQ ID NO: 863 - RNA, 21 nt, Artificial Sequence
  source: /note="Description of Artificial Sequence: Synthetic oligonucleotide"
aacaucaccaugcagauuaua

SEQ ID NO: 864 - RNA, 21 nt, Artificial Sequence
  source: /note="Description of Artificial Sequence: Synthetic oligonucleotide"
cgcagacguguaaauguucca

SEQ ID NO: 865 - RNA, 21 nt, Artificial Sequence
  source: /note="Description of Artificial Sequence: Synthetic oligonucleotide"
agcuugaguuaaacgaacgua

SEQ ID NO: 866 - RNA, 21 nt, Artificial Sequence
  source: /note="Description of Artificial Sequence: Synthetic oligonucleotide"
gcacugaaacuuuucguccaa

SEQ ID NO: 867 - RNA, 21 nt, Artificial Sequence
  source: /note="Description of Artificial Sequence: Synthetic oligonucleotide"
aauucuacauacuaaaucuca

SEQ ID NO: 868 - RNA, 21 nt, Artificial Sequence
  source: /note="Description of Artificial Sequence: Synthetic oligonucleotide"
ccgcagacguguaaauguuca

SEQ ID NO: 869 - RNA, 21 nt, Artificial Sequence
  source: /note="Description of Artificial Sequence: Synthetic oligonucleotide"
uccgcagacguguaaauguua

SEQ ID NO: 870 - RNA, 21 nt, Artificial Sequence
  source: /note="Description of Artificial Sequence: Synthetic oligonucleotide"
cgcacugaaacuuuucgucca

SEQ ID NO: 871 - RNA, 21 nt, Artificial Sequence
  source: /note="Description of Artificial Sequence: Synthetic oligonucleotide"
cccucuuggaauuggauucga

SEQ ID NO: 872 - RNA, 21 nt, Artificial Sequence
  source: /note="Description of Artificial Sequence: Synthetic oligonucleotide"
cagacguguaaauguuccuga

SEQ ID NO: 873 - RNA, 21 nt, Artificial Sequence
  source: /note="Description of Artificial Sequence: Synthetic oligonucleotide"
acgaacguacuugcagaugua

SEQ ID NO: 874 - RNA, 21 nt, Artificial Sequence
  source: /note="Description of Artificial Sequence: Synthetic oligonucleotide"
auccgcagacguguaaaugua

SEQ ID NO: 875 - RNA, 21 nt, Artificial Sequence
  source: /note="Description of Artificial Sequence: Synthetic oligonucleotide"
cagaaucaucacgaaguggua

SEQ ID NO: 876 - RNA, 21 nt, Artificial Sequence
  source: /note="Description of Artificial Sequence: Synthetic oligonucleotide"
ccugcaaaaacacagacucga

SEQ ID NO: 877 - RNA, 21 nt, Artificial Sequence
  source: /note="Description of Artificial Sequence: Synthetic oligonucleotide"
aggacauugcugugcuuugga

SEQ ID NO: 878 - RNA, 21 nt, Artificial Sequence
  source: /note="Description of Artificial Sequence: Synthetic oligonucleotide"
gggcagaaucaucacgaagua

SEQ ID NO: 879 - RNA, 21 nt, Artificial Sequence
  source: /note="Description of Artificial Sequence: Synthetic oligonucleotide"
ugaaguucauggaugucuaua

SEQ ID NO: 880 - RNA, 21 nt, Artificial Sequence
  source: /note="Description of Artificial Sequence: Synthetic oligonucleotide"
cgucgcacugaaacuuuucga

SEQ ID NO: 881 - RNA, 21 nt, Artificial Sequence
  source: /note="Description of Artificial Sequence: Synthetic oligonucleotide"
gaaaaaaaaucaguucgagga

SEQ ID NO: 882 - RNA, 21 nt, Artificial Sequence
  source: /note="Description of Artificial Sequence: Synthetic oligonucleotide"
auuggugucuucacuggauga

SEQ ID NO: 883 - RNA, 21 nt, Artificial Sequence
  source: /note="Description of Artificial Sequence: Synthetic oligonucleotide"
agauccgcagacguguaaaua

SEQ ID NO: 884 - RNA, 21 nt, Artificial Sequence
  source: /note="Description of Artificial Sequence: Synthetic oligonucleotide"
gauccgcagacguguaaauga

SEQ ID NO: 885 - RNA, 21 nt, Artificial Sequence
  source: /note="Description of Artificial Sequence: Synthetic oligonucleotide"
uuguuuguacaagauccgcaa

SEQ ID NO: 886 - RNA, 21 nt, Artificial Sequence
  source: /note="Description of Artificial Sequence: Synthetic oligonucleotide"
ugcuguggacuugaguuggga

SEQ ID NO: 887 - RNA, 21 nt, Artificial Sequence
  source: /note="Description of Artificial Sequence: Synthetic oligonucleotide"
cacgucuuugucucuagugca

SEQ ID NO: 888 - RNA, 21 nt, Artificial Sequence
  source: /note="Description of Artificial Sequence: Synthetic oligonucleotide"
uuuuuuucaguauucuuggua

SEQ ID NO: 889 - RNA, 21 nt, Artificial Sequence
  source: /note="Description of Artificial Sequence: Synthetic oligonucleotide"
gugcuggaauuugauauucaa

SEQ ID NO: 890 - RNA, 21 nt, Artificial Sequence
  source: /note="Description of Artificial Sequence: Synthetic oligonucleotide"
uuaacaucacgucuuugucua

SEQ ID NO: 891 - RNA, 21 nt, Artificial Sequence
  source: /note="Description of Artificial Sequence: Synthetic oligonucleotide"
aggggcaaaaacgaaagcgca

SEQ ID NO: 892 - RNA, 21 nt, Artificial Sequence
  source: /note="Description of Artificial Sequence: Synthetic oligonucleotide"
aaagugagugaccugcuuuua

SEQ ID NO: 893 - RNA, 21 nt, Artificial Sequence
  source: /note="Description of Artificial Sequence: Synthetic oligonucleotide"
aaaaacacagacucgcguuga

SEQ ID NO: 894 - RNA, 21 nt, Artificial Sequence
  source: /note="Description of Artificial Sequence: Synthetic oligonucleotide"
auuuguuuguacaagauccga

SEQ ID NO: 895 - RNA, 21 nt, Artificial Sequence
  source: /note="Description of Artificial Sequence: Synthetic oligonucleotide"
uuccccaaaucacuguggaua

SEQ ID NO: 896 - RNA, 21 nt, Artificial Sequence
  source: /note="Description of Artificial Sequence: Synthetic oligonucleotide"
auuaacaucacgucuuuguca

SEQ ID NO: 897 - RNA, 21 nt, Artificial Sequence
  source: /note="Description of Artificial Sequence: Synthetic oligonucleotide"
cgucuuugucucuagugcaga

SEQ ID NO: 898 - RNA, 21 nt, Artificial Sequence
  source: /note="Description of Artificial Sequence: Synthetic oligonucleotide"
aaaacacagacucgcguugca

SEQ ID NO: 899 - RNA, 21 nt, Artificial Sequence
  source: /note="Description of Artificial Sequence: Synthetic oligonucleotide"
ugcaaaaacacagacucgcga

SEQ ID NO: 900 - RNA, 21 nt, Artificial Sequence
  source: /note="Description of Artificial Sequence: Synthetic oligonucleotide"
aacacagacucgcguugcaaa

SEQ ID NO: 901 - RNA, 21 nt, Artificial Sequence
  source: /note="Description of Artificial Sequence: Synthetic oligonucleotide"
cuugcagaugugacaagccga

SEQ ID NO: 902 - RNA, 21 nt, Artificial Sequence
  source: /note="Description of Artificial Sequence: Synthetic oligonucleotide"
uuuauccguaauaauugugga

SEQ ID NO: 903 - RNA, 21 nt, Artificial Sequence
  source: /note="Description of Artificial Sequence: Synthetic oligonucleotide"
gcaaaaacacagacucgcgua

SEQ ID NO: 904 - RNA, 21 nt, Artificial Sequence
  source: /note="Description of Artificial Sequence: Synthetic oligonucleotide"
guuuauccguaauaauuguga

SEQ ID NO: 905 - RNA, 21 nt, Artificial Sequence
  source: /note="Description of Artificial Sequence: Synthetic oligonucleotide"
gggcaaaaacgaaagcgcaaa

SEQ ID NO: 906 - RNA, 21 nt, Artificial Sequence
  source: /note="Description of Artificial Sequence: Synthetic oligonucleotide"
uuauccguaauaauuguggga

SEQ ID NO: 907 - RNA, 23 nt, Artificial Sequence
  source: /note="Description of Artificial Sequence: Synthetic oligonucleotide"
uaucgaucguucuguaucagucu

SEQ ID NO: 908 - RNA, 23 nt, Artificial Sequence
  source: /note="Description of Artificial Sequence: Synthetic oligonucleotide"
uaucguucuguaucagucuuucc

SEQ ID NO: 909 - RNA, 23 nt, Artificial Sequence
  source: /note="Description of Artificial Sequence: Synthetic oligonucleotide"
ucguauauaaaacacuuucucuu

SEQ ID NO: 910 - RNA, 23 nt, Artificial Sequence
  source: /note="Description of Artificial Sequence: Synthetic oligonucleotide"
ucgaucguucuguaucagucuuu

SEQ ID NO: 911 - RNA, 23 nt, Artificial Sequence
  source: /note="Description of Artificial Sequence: Synthetic oligonucleotide"
uauacaucucauaaauaguugaa

SEQ ID NO: 912 - RNA, 23 nt, Artificial Sequence
  source: /note="Description of Artificial Sequence: Synthetic oligonucleotide"
ugaucguucuguaucagucuuuc

SEQ ID NO: 913 - RNA, 23 nt, Artificial Sequence
  source: /note="Description of Artificial Sequence: Synthetic oligonucleotide"
ucuguaucgaucguucuguauca

SEQ ID NO: 914 - RNA, 23 nt, Artificial Sequence
  source: /note="Description of Artificial Sequence: Synthetic oligonucleotide"
uccaauaacauuagcacuguuaa

SEQ ID NO: 915 - RNA, 23 nt, Artificial Sequence
  source: /note="Description of Artificial Sequence: Synthetic oligonucleotide"
ugacaccaauaacauuagcacug

SEQ ID NO: 916 - RNA, 23 nt, Artificial Sequence
  source: /note="Description of Artificial Sequence: Synthetic oligonucleotide"
ugauacaucucauaaauaguuga

SEQ ID NO: 917 - RNA, 23 nt, Artificial Sequence
  source: /note="Description of Artificial Sequence: Synthetic oligonucleotide"
ucuggauuaaggacuguucuguc

SEQ ID NO: 918 - RNA, 23 nt, Artificial Sequence
  source: /note="Description of Artificial Sequence: Synthetic oligonucleotide"
uucgaucguucuguaucagucuu

SEQ ID NO: 919 - RNA, 23 nt, Artificial Sequence
  source: /note="Description of Artificial Sequence: Synthetic oligonucleotide"
uauucacauuuguugugcuguag

SEQ ID NO: 920 - RNA, 23 nt, Artificial Sequence
  source: /note="Description of Artificial Sequence: Synthetic oligonucleotide"
ucagaauagcaaugucuauuuua

SEQ ID NO: 921 - RNA, 23 nt, Artificial Sequence
  source: /note="Description of Artificial Sequence: Synthetic oligonucleotide"
uauccagugaagacaccaauaac

SEQ ID NO: 922 - RNA, 23 nt, Artificial Sequence
  source: /note="Description of Artificial Sequence: Synthetic oligonucleotide"
uuaucgaucguucuguaucaguc

SEQ ID NO: 923 - RNA, 23 nt, Artificial Sequence
  source: /note="Description of Artificial Sequence: Synthetic oligonucleotide"
uaccgguacaaauaagagagcaa

SEQ ID NO: 924 - RNA, 23 nt, Artificial Sequence
  source: /note="Description of Artificial Sequence: Synthetic oligonucleotide"
uaacuagugguuucaauggugug

SEQ ID NO: 925 - RNA, 23 nt, Artificial Sequence
  source: /note="Description of Artificial Sequence: Synthetic oligonucleotide"
uuucguuuaacucaagcugccuc

SEQ ID NO: 926 - RNA, 23 nt, Artificial Sequence
  source: /note="Description of Artificial Sequence: Synthetic oligonucleotide"
ucugcaaguacguucguuuaacu

SEQ ID NO: 927 - RNA, 23 nt, Artificial Sequence
  source: /note="Description of Artificial Sequence: Synthetic oligonucleotide"
uaagcuagugacugucaccgauc

SEQ ID NO: 928 - RNA, 23 nt, Artificial Sequence
  source: /note="Description of Artificial Sequence: Synthetic oligonucleotide"
ugcaaguacguucguuuaacuca

SEQ ID NO: 929 - RNA, 23 nt, Artificial Sequence
  source: /note="Description of Artificial Sequence: Synthetic oligonucleotide"
uguucguuuaacucaagcugccu

SEQ ID NO: 930 - RNA, 23 nt, Artificial Sequence
  source: /note="Description of Artificial Sequence: Synthetic oligonucleotide"
uacaccaauaacauuagcacugu

SEQ ID NO: 931 - RNA, 23 nt, Artificial Sequence
  source: /note="Description of Artificial Sequence: Synthetic oligonucleotide"
uccaugaacuucaccacuucgug

SEQ ID NO: 932 - RNA, 23 nt, Artificial Sequence
  source: /note="Description of Artificial Sequence: Synthetic oligonucleotide"
ucuuguacaaacaaaugcuuucu

SEQ ID NO: 933 - RNA, 23 nt, Artificial Sequence
  source: /note="Description of Artificial Sequence: Synthetic oligonucleotide"
uuuucaauggugugaggacauag

SEQ ID NO: 934 - RNA, 23 nt, Artificial Sequence
  source: /note="Description of Artificial Sequence: Synthetic oligonucleotide"
uaaguacguucguuuaacucaag

SEQ ID NO: 935 - RNA, 23 nt, Artificial Sequence
  source: /note="Description of Artificial Sequence: Synthetic oligonucleotide"
uacuagugguuucaaugguguga

SEQ ID NO: 936 - RNA, 23 nt, Artificial Sequence
  source: /note="Description of Artificial Sequence: Synthetic oligonucleotide"
uaacgcgagucuguguuuuugca

SEQ ID NO: 937 - RNA, 23 nt, Artificial Sequence
  source: /note="Description of Artificial Sequence: Synthetic oligonucleotide"
uguuucaauggugugaggacaua

SEQ ID NO: 938 - RNA, 23 nt, Artificial Sequence
  source: /note="Description of Artificial Sequence: Synthetic oligonucleotide"
ucguucguuuaacucaagcugcc

SEQ ID NO: 939 - RNA, 23 nt, Artificial Sequence
  source: /note="Description of Artificial Sequence: Synthetic oligonucleotide"
uuacggauaaacaguagcaccaa

SEQ ID NO: 940 - RNA, 23 nt, Artificial Sequence
  source: /note="Description of Artificial Sequence: Synthetic oligonucleotide"
ucgguacaaauaagagagcaaga

SEQ ID NO: 941 - RNA, 23 nt, Artificial Sequence
  source: /note="Description of Artificial Sequence: Synthetic oligonucleotide"
uucggugauuuagcagcaagaaa

SEQ ID NO: 942 - RNA, 23 nt, Artificial Sequence
  source: /note="Description of Artificial Sequence: Synthetic oligonucleotide"
ugggauauuaaauaaguaccgua

SEQ ID NO: 943 - RNA, 23 nt, Artificial Sequence
  source: /note="Description of Artificial Sequence: Synthetic oligonucleotide"
uagaauagcaaugucuauuuuau

SEQ ID NO: 944 - RNA, 23 nt, Artificial Sequence
  source: /note="Description of Artificial Sequence: Synthetic oligonucleotide"
uccagaaguuggacgaaaaguuu

SEQ ID NO: 945 - RNA, 23 nt, Artificial Sequence
  source: /note="Description of Artificial Sequence: Synthetic oligonucleotide"
ucggauaaacaguagcaccaaua

SEQ ID NO: 946 - RNA, 23 nt, Artificial Sequence
  source: /note="Description of Artificial Sequence: Synthetic oligonucleotide"
uccagugaagacaccaauaacau

SEQ ID NO: 947 - RNA, 23 nt, Artificial Sequence
  source: /note="Description of Artificial Sequence: Synthetic oligonucleotide"
ucagcccagaaguuggacgaaaa

SEQ ID NO: 948 - RNA, 23 nt, Artificial Sequence
  source: /note="Description of Artificial Sequence: Synthetic oligonucleotide"
ucggugauuuagcagcaagaaaa

SEQ ID NO: 949 - RNA, 23 nt, Artificial Sequence
  source: /note="Description of Artificial Sequence: Synthetic oligonucleotide"
uagggauauuaaauaaguaccgu

SEQ ID NO: 950 - RNA, 23 nt, Artificial Sequence
  source: /note="Description of Artificial Sequence: Synthetic oligonucleotide"
ucaaagacgugauguuaauaucu

SEQ ID NO: 951 - RNA, 23 nt, Artificial Sequence
  source: /note="Description of Artificial Sequence: Synthetic oligonucleotide"
ucguuuaacucaagcugccucgc

SEQ ID NO: 952 - RNA, 23 nt, Artificial Sequence
  source: /note="Description of Artificial Sequence: Synthetic oligonucleotide"
uuuacggauaaacaguagcacca

SEQ ID NO: 953 - RNA, 23 nt, Artificial Sequence
  source: /note="Description of Artificial Sequence: Synthetic oligonucleotide"
uucguuuaacucaagcugccucg

SEQ ID NO: 954 - RNA, 23 nt, Artificial Sequence
  source: /note="Description of Artificial Sequence: Synthetic oligonucleotide"
uacggauaaacaguagcaccaau

SEQ ID NO: 955 - RNA, 23 nt, Artificial Sequence
  source: /note="Description of Artificial Sequence: Synthetic oligonucleotide"
ucgcuuucguuuuugccccuuuc

SEQ ID NO: 956 - RNA, 23 nt, Artificial Sequence
  source: /note="Description of Artificial Sequence: Synthetic oligonucleotide"
ucaagauaagcuagugacuguca

SEQ ID NO: 957 - RNA, 23 nt, Artificial Sequence
  source: /note="Description of Artificial Sequence: Synthetic oligonucleotide"
uggauauuaaauaaguaccguau

SEQ ID NO: 958 - RNA, 23 nt, Artificial Sequence
  source: /note="Description of Artificial Sequence: Synthetic oligonucleotide"
ucaaguacguucguuuaacucaa

SEQ ID NO: 959 - RNA, 23 nt, Artificial Sequence
  source: /note="Description of Artificial Sequence: Synthetic oligonucleotide"
ucagugaagacaccaauaacauu

SEQ ID NO: 960 - RNA, 23 nt, Artificial Sequence
  source: /note="Description of Artificial Sequence: Synthetic oligonucleotide"
ugauuaaggacuguucugucgau

SEQ ID NO: 961 - RNA, 23 nt, Artificial Sequence
  source: /note="Description of Artificial Sequence: Synthetic oligonucleotide"
uccuuuccucgaacugauuuuuu

SEQ ID NO: 962 - RNA, 23 nt, Artificial Sequence
  source: /note="Description of Artificial Sequence: Synthetic oligonucleotide"
uauggcgaauccaauuccaagag

SEQ ID NO: 963 - RNA, 23 nt, Artificial Sequence
  source: /note="Description of Artificial Sequence: Synthetic oligonucleotide"
ucaacaaugugucucuucucuuc

SEQ ID NO: 964 - RNA, 23 nt, Artificial Sequence
  source: /note="Description of Artificial Sequence: Synthetic oligonucleotide"
uugcacuagagacaaagacguga

SEQ ID NO: 965 - RNA, 23 nt, Artificial Sequence
  source: /note="Description of Artificial Sequence: Synthetic oligonucleotide"
uagauaagcuagugacugucacc

SEQ ID NO: 966 - RNA, 23 nt, Artificial Sequence
  source: /note="Description of Artificial Sequence: Synthetic oligonucleotide"
uaguacguucguuuaacucaagc

SEQ ID NO: 967 - RNA, 23 nt, Artificial Sequence
  source: /note="Description of Artificial Sequence: Synthetic oligonucleotide"
uuuguacaaacaaaugcuuucuc

SEQ ID NO: 968 - RNA, 23 nt, Artificial Sequence
  source: /note="Description of Artificial Sequence: Synthetic oligonucleotide"
ucgcauaaucugcauggugaugu

SEQ ID NO: 969 - RNA, 23 nt, Artificial Sequence
  source: /note="Description of Artificial Sequence: Synthetic oligonucleotide"
uuccgcauaaucugcauggugau

SEQ ID NO: 970 - RNA, 23 nt, Artificial Sequence
  source: /note="Description of Artificial Sequence: Synthetic oligonucleotide"
uguacguucguuuaacucaagcu

SEQ ID NO: 971 - RNA, 23 nt, Artificial Sequence
  source: /note="Description of Artificial Sequence: Synthetic oligonucleotide"
uucggcuugucacaucugcaagu

SEQ ID NO: 972 - RNA, 23 nt, Artificial Sequence
  source: /note="Description of Artificial Sequence: Synthetic oligonucleotide"
uagauacaucucauaaauaguug

SEQ ID NO: 973 - RNA, 23 nt, Artificial Sequence
  source: /note="Description of Artificial Sequence: Synthetic oligonucleotide"
uccaagaauacugaaaaaaaacc

SEQ ID NO: 974 - RNA, 23 nt, Artificial Sequence
  source: /note="Description of Artificial Sequence: Synthetic oligonucleotide"
uauaaguaccguauauaaaacac

SEQ ID NO: 975 - RNA, 23 nt, Artificial Sequence
  source: /note="Description of Artificial Sequence: Synthetic oligonucleotide"
uaccguauauaaaacacuuucuc

SEQ ID NO: 976 - RNA, 23 nt, Artificial Sequence
  source: /note="Description of Artificial Sequence: Synthetic oligonucleotide"
ucagucaaauacauccagugaag

SEQ ID NO: 977 - RNA, 23 nt, Artificial Sequence
  source: /note="Description of Artificial Sequence: Synthetic oligonucleotide"
uuacguucguuuaacucaagcug

SEQ ID NO: 978 - RNA, 23 nt, Artificial Sequence
  source: /note="Description of Artificial Sequence: Synthetic oligonucleotide"
uaaaguucaugguuucggaggcc

SEQ ID NO: 979 - RNA, 23 nt, Artificial Sequence
  source: /note="Description of Artificial Sequence: Synthetic oligonucleotide"
ucuuuccucgaacugauuuuuuu

SEQ ID NO: 980 - RNA, 23 nt, Artificial Sequence
  source: /note="Description of Artificial Sequence: Synthetic oligonucleotide"
uauuuaguauguagaauucucua

SEQ ID NO: 981 - RNA, 23 nt, Artificial Sequence
  source: /note="Description of Artificial Sequence: Synthetic oligonucleotide"
uagguuugauccgcauaaucugc

SEQ ID NO: 982 - RNA, 23 nt, Artificial Sequence
  source: /note="Description of Artificial Sequence: Synthetic oligonucleotide"
ucccuuuccucgaacugauuuuu

SEQ ID NO: 983 - RNA, 23 nt, Artificial Sequence
  source: /note="Description of Artificial Sequence: Synthetic oligonucleotide"
ugaucuuguacaaacaaaugcuu

SEQ ID NO: 984 - RNA, 23 nt, Artificial Sequence
  source: /note="Description of Artificial Sequence: Synthetic oligonucleotide"
uaugaacuucaccacuucgugau

SEQ ID NO: 985 - RNA, 23 nt, Artificial Sequence
  source: /note="Description of Artificial Sequence: Synthetic oligonucleotide"
ucauuucagguuucuggauuaag

SEQ ID NO: 986 - RNA, 23 nt, Artificial Sequence
  source: /note="Description of Artificial Sequence: Synthetic oligonucleotide"
ucacaggauggcuugaagaugua

SEQ ID NO: 987 - RNA, 23 nt, Artificial Sequence
  source: /note="Description of Artificial Sequence: Synthetic oligonucleotide"
uauuacggauaaacaguagcacc

SEQ ID NO: 988 - RNA, 23 nt, Artificial Sequence
  source: /note="Description of Artificial Sequence: Synthetic oligonucleotide"
ugcucggugauuuagcagcaaga

SEQ ID NO: 989 - RNA, 23 nt, Artificial Sequence
  source: /note="Description of Artificial Sequence: Synthetic oligonucleotide"
uaaagacgugauguuaauaucuu

SEQ ID NO: 990 - RNA, 23 nt, Artificial Sequence
  source: /note="Description of Artificial Sequence: Synthetic oligonucleotide"
ugcgagucuguguuuuugcagga

SEQ ID NO: 991 - RNA, 23 nt, Artificial Sequence
  source: /note="Description of Artificial Sequence: Synthetic oligonucleotide"
ucucggugauuuagcagcaagaa

SEQ ID NO: 992 - RNA, 23 nt, Artificial Sequence
  source: /note="Description of Artificial Sequence: Synthetic oligonucleotide"
uccguauauaaaacacuuucucu

SEQ ID NO: 993 - RNA, 23 nt, Artificial Sequence
  source: /note="Description of Artificial Sequence: Synthetic oligonucleotide"
uauaaucugcauggugauguugg

SEQ ID NO: 994 - RNA, 23 nt, Artificial Sequence
  source: /note="Description of Artificial Sequence: Synthetic oligonucleotide"
uggaacauuuacacgucugcgga

SEQ ID NO: 995 - RNA, 23 nt, Artificial Sequence
  source: /note="Description of Artificial Sequence: Synthetic oligonucleotide"
uacguucguuuaacucaagcugc

SEQ ID NO: 996 - RNA, 23 nt, Artificial Sequence
  source: /note="Description of Artificial Sequence: Synthetic oligonucleotide"
uuggacgaaaaguuucagugcga

SEQ ID NO: 997 - RNA, 23 nt, Artificial Sequence
  source: /note="Description of Artificial Sequence: Synthetic oligonucleotide"
ugagauuuaguauguagaauucu

SEQ ID NO: 998 - RNA, 23 nt, Artificial Sequence
  source: /note="Description of Artificial Sequence: Synthetic oligonucleotide"
ugaacauuuacacgucugcggau

SEQ ID NO: 999 - RNA, 23 nt, Artificial Sequence
  source: /note="Description of Artificial Sequence: Synthetic oligonucleotide"
uaacauuuacacgucugcggauc

SEQ ID NO: 1000 - RNA, 23 nt, Artificial Sequence
  source: /note="Description of Artificial Sequence: Synthetic oligonucleotide"
uggacgaaaaguuucagugcgac

SEQ ID NO: 1001 - RNA, 23 nt, Artificial Sequence
  source: /note="Description of Artificial Sequence: Synthetic oligonucleotide"
ucgaauccaauuccaagagggac

SEQ ID NO: 1002 - RNA, 23 nt, Artificial Sequence
  source: /note="Description of Artificial Sequence: Synthetic oligonucleotide"
ucaggaacauuuacacgucugcg

SEQ ID NO: 1003 - RNA, 23 nt, Artificial Sequence
  source: /note="Description of Artificial Sequence: Synthetic oligonucleotide"
uacaucugcaaguacguucguuu

SEQ ID NO: 1004 - RNA, 23 nt, Artificial Sequence
  source: /note="Description of Artificial Sequence: Synthetic oligonucleotide"
uacauuuacacgucugcggaucu

SEQ ID NO: 1005 - RNA, 23 nt, Artificial Sequence
  source: /note="Description of Artificial Sequence: Synthetic oligonucleotide"
uaccacuucgugaugauucugcc

SEQ ID NO: 1006 - RNA, 23 nt, Artificial Sequence
  source: /note="Description of Artificial Sequence: Synthetic oligonucleotide"
ucgagucuguguuuuugcaggaa

SEQ ID NO: 1007 - RNA, 23 nt, Artificial Sequence
  source: /note="Description of Artificial Sequence: Synthetic oligonucleotide"
uccaaagcacagcaauguccuga

SEQ ID NO: 1008 - RNA, 23 nt, Artificial Sequence
  source: /note="Description of Artificial Sequence: Synthetic oligonucleotide"
uacuucgugaugauucugcccuc

SEQ ID NO: 1009 - RNA, 23 nt, Artificial Sequence
  source: /note="Description of Artificial Sequence: Synthetic oligonucleotide"
uauagacauccaugaacuucacc

SEQ ID NO: 1010 - RNA, 23 nt, Artificial Sequence
  source: /note="Description of Artificial Sequence: Synthetic oligonucleotide"
ucgaaaaguuucagugcgacgcc

SEQ ID NO: 1011 - RNA, 23 nt, Artificial Sequence
  source: /note="Description of Artificial Sequence: Synthetic oligonucleotide"
uccucgaacugauuuuuuuucuu

SEQ ID NO: 1012 - RNA, 23 nt, Artificial Sequence
  source: /note="Description of Artificial Sequence: Synthetic oligonucleotide"
ucauccagugaagacaccaauaa

SEQ ID NO: 1013 - RNA, 23 nt, Artificial Sequence
  source: /note="Description of Artificial Sequence: Synthetic oligonucleotide"
uauuuacacgucugcggaucuug

SEQ ID NO: 1014 - RNA, 23 nt, Artificial Sequence
  source: /note="Description of Artificial Sequence: Synthetic oligonucleotide"
ucauuuacacgucugcggaucuu

SEQ ID NO: 1015 - RNA, 23 nt, Artificial Sequence
  source: /note="Description of Artificial Sequence: Synthetic oligonucleotide"
uugcggaucuuguacaaacaaau

SEQ ID NO: 1016 - RNA, 23 nt, Artificial Sequence
  source: /note="Description of Artificial Sequence: Synthetic oligonucleotide"
ucccaacucaaguccacagcagu

SEQ ID NO: 1017 - RNA, 23 nt, Artificial Sequence
  source: /note="Description of Artificial Sequence: Synthetic oligonucleotide"
ugcacuagagacaaagacgugau

SEQ ID NO: 1018 - RNA, 23 nt, Artificial Sequence
  source: /note="Description of Artificial Sequence: Synthetic oligonucleotide"
uaccaagaauacugaaaaaaaac

SEQ ID NO: 1019 - RNA, 23 nt, Artificial Sequence
  source: /note="Description of Artificial Sequence: Synthetic oligonucleotide"
uugaauaucaaauuccagcaccg

SEQ ID NO: 1020 - RNA, 23 nt, Artificial Sequence
  source: /note="Description of Artificial Sequence: Synthetic oligonucleotide"
uagacaaagacgugauguuaaua

SEQ ID NO: 1021 - RNA, 23 nt, Artificial Sequence
  source: /note="Description of Artificial Sequence: Synthetic oligonucleotide"
ugcgcuuucguuuuugccccuuu

SEQ ID NO: 1022 - RNA, 23 nt, Artificial Sequence
  source: /note="Description of Artificial Sequence: Synthetic oligonucleotide"
uaaaagcaggucacucacuuugc

SEQ ID NO: 1023 - RNA, 23 nt, Artificial Sequence
  source: /note="Description of Artificial Sequence: Synthetic oligonucleotide"
ucaacgcgagucuguguuuuugc

SEQ ID NO: 1024 - RNA, 23 nt, Artificial Sequence
  source: /note="Description of Artificial Sequence: Synthetic oligonucleotide"
ucggaucuuguacaaacaaaugc

SEQ ID NO: 1025 - RNA, 23 nt, Artificial Sequence
  source: /note="Description of Artificial Sequence: Synthetic oligonucleotide"
uauccacagugauuuggggaagu

SEQ ID NO: 1026 - RNA, 23 nt, Artificial Sequence
  source: /note="Description of Artificial Sequence: Synthetic oligonucleotide"
ugacaaagacgugauguuaauau

SEQ ID NO: 1027 - RNA, 23 nt, Artificial Sequence
  source: /note="Description of Artificial Sequence: Synthetic oligonucleotide"
ucugcacuagagacaaagacgug

SEQ ID NO: 1028 - RNA, 23 nt, Artificial Sequence
  source: /note="Description of Artificial Sequence: Synthetic oligonucleotide"
ugcaacgcgagucuguguuuuug

SEQ ID NO: 1029 - RNA, 23 nt, Artificial Sequence
  source: /note="Description of Artificial Sequence: Synthetic oligonucleotide"
ucgcgagucuguguuuuugcagg

SEQ ID NO: 1030 - RNA, 23 nt, Artificial Sequence
  source: /note="Description of Artificial Sequence: Synthetic oligonucleotide"
uuugcaacgcgagucuguguuuu

SEQ ID NO: 1031 - RNA, 23 nt, Artificial Sequence
  source: /note="Description of Artificial Sequence: Synthetic oligonucleotide"
ucggcuugucacaucugcaagua

SEQ ID NO: 1032 - RNA, 23 nt, Artificial Sequence
  source: /note="Description of Artificial Sequence: Synthetic oligonucleotide"
uccacaauuauuacggauaaaca

SEQ ID NO: 1033 - RNA, 23 nt, Artificial Sequence
  source: /note="Description of Artificial Sequence: Synthetic oligonucleotide"
uacgcgagucuguguuuuugcag

SEQ ID NO: 1034 - RNA, 23 nt, Artificial Sequence
  source: /note="Description of Artificial Sequence: Synthetic oligonucleotide"
ucacaauuauuacggauaaacag

SEQ ID NO: 1035 - RNA, 23 nt, Artificial Sequence
  source: /note="Description of Artificial Sequence: Synthetic oligonucleotide"
uuugcgcuuucguuuuugccccu

SEQ ID NO: 1036 - RNA, 23 nt, Artificial Sequence
  source: /note="Description of Artificial Sequence: Synthetic oligonucleotide"
ucccacaauuauuacggauaaac

SEQ ID NO: 1037 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaauagacatugcuauucua

SEQ ID NO: 1038 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugcuaatgtuauuggugua

SEQ ID NO: 1039 - RNA, 21 nt, Artificial Sequence
  source: /note="Description of Artificial Sequence: Synthetic oligonucleotide"
auacagaacgaucgauacaga

SEQ ID NO: 1040 - RNA, 21 nt, Artificial Sequence
  source: /note="Description of Artificial Sequence: Synthetic oligonucleotide"
acagcacaacaaaugugaaua

SEQ ID NO: 1041 - RNA, 21 nt, Artificial Sequence
  source: /note="Description of Artificial Sequence: Synthetic oligonucleotide"
cugauacagaacgaucgauaa

SEQ ID NO: 1042 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagaaagugutuuauauacga

SEQ ID NO: 1043 - RNA, 21 nt, Artificial Sequence
  source: /note="Description of Artificial Sequence: Synthetic oligonucleotide"
aacuauuuaugagauguauca

SEQ ID NO: 1044 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagacugatacagaacgauca

SEQ ID NO: 1045 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagaauuctacauacuaaaua

SEQ ID NO: 1046 - RNA, 21 nt, Artificial Sequence
  source: /note="Description of Artificial Sequence: Synthetic oligonucleotide"
aaagacugauacagaacgaua

SEQ ID NO: 1047 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgguacutatuuaauaucca

SEQ ID NO: 1048 - RNA, 21 nt, Artificial Sequence
  source: /note="Description of Artificial Sequence: Synthetic oligonucleotide"
acugauacagaacgaucgaua

SEQ ID NO: 1049 - RNA, 21 nt, Artificial Sequence
  source: /note="Description of Artificial Sequence: Synthetic oligonucleotide"
cgacagaacaguccuuaauca

SEQ ID NO: 1050 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaacagtccuuaauccaga

SEQ ID NO: 1051 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacagugctaauguuauugga

SEQ ID NO: 1052 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagucactagcuuaucuuga

SEQ ID NO: 1053 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugcugctaaaucaccgaga

SEQ ID NO: 1054 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaagugututauauacggua

SEQ ID NO: 1055 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcucucuuautuguaccggua

SEQ ID NO: 1056 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuugcugctaaaucaccga

SEQ ID NO: 1057 - RNA, 21 nt, Artificial Sequence
  source: /note="Description of Artificial Sequence: Synthetic oligonucleotide"
caccauugaaaccacuaguua

SEQ ID NO: 1058 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgguacuuautuaauauccca

SEQ ID NO: 1059 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacuauutatgagauguaua

SEQ ID NO: 1060 - RNA, 21 nt, Artificial Sequence
  source: /note="Description of Artificial Sequence: Synthetic oligonucleotide"
uaauccagaaaccugaaauga

SEQ ID NO: 1061 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauagacautgcuauucuga

SEQ ID NO: 1062 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagcauutgtuuguacaaga

SEQ ID NO: 1063 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuggaautggauucgccaua

SEQ ID NO: 1064 - RNA, 21 nt, Artificial Sequence
  source: /note="Description of Artificial Sequence: Synthetic oligonucleotide"
acaccauugaaaccacuagua

SEQ ID NO: 1065 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaucaccatgcagauuaua

SEQ ID NO: 1066 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugacagucactagcuuaucua

SEQ ID NO: 1067 - RNA, 21 nt, Artificial Sequence
  source: /note="Description of Artificial Sequence: Synthetic oligonucleotide"
aguuaaacgaacguacuugca

SEQ ID NO: 1068 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuauuuatgagauguaucua

SEQ ID NO: 1069 - RNA, 21 nt, Artificial Sequence
  source: /note="Description of Artificial Sequence: Synthetic oligonucleotide"
uuaaacgaacguacuugcaga

SEQ ID NO: 1070 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguacuuatutaauaucccua

SEQ ID NO: 1071 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgaaguggtgaaguucaugga

SEQ ID NO: 1072 - RNA, 21 nt, Artificial Sequence
  source: /note="Description of Artificial Sequence: Synthetic oligonucleotide"
uguuauuggugucuucacuga

SEQ ID NO: 1073 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcucuctuauuuguaccga

SEQ ID NO: 1074 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuuuauatacgguacuuaua

SEQ ID NO: 1075 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacuggatgtauuugacuga

SEQ ID NO: 1076 - RNA, 21 nt, Artificial Sequence
  source: /note="Description of Artificial Sequence: Synthetic oligonucleotide"
ccuccgaaaccaugaacuuua

SEQ ID NO: 1077 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuggugtctucacuggaua

SEQ ID NO: 1078 - RNA, 21 nt, Artificial Sequence
  source: /note="Description of Artificial Sequence: Synthetic oligonucleotide"
agacugauacagaacgaucga

SEQ ID NO: 1079 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgcagacgtguaaauguua

SEQ ID NO: 1080 - RNA, 21 nt, Artificial Sequence
  source: /note="Description of Artificial Sequence: Synthetic oligonucleotide"
gaguuaaacgaacguacuuga

SEQ ID NO: 1081 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaagugtutuauauacgga

SEQ ID NO: 1082 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuauuggtgtcuucacugga

SEQ ID NO: 1083 - RNA, 21 nt, Artificial Sequence
  source: /note="Description of Artificial Sequence: Synthetic oligonucleotide"
cuugaguuaaacgaacguaca

SEQ ID NO: 1084 - RNA, 21 nt, Artificial Sequence
  source: /note="Description of Artificial Sequence: Synthetic oligonucleotide"
ugaguuaaacgaacguacuua

SEQ ID NO: 1085 - RNA, 21 nt, Artificial Sequence
  source: /note="Description of Artificial Sequence: Synthetic oligonucleotide"
aucaccaugcagauuaugcga

SEQ ID NO: 1086 - RNA, 21 nt, Artificial Sequence
  source: /note="Description of Artificial Sequence: Synthetic oligonucleotide"
uugaguuaaacgaacguacua

SEQ ID NO: 1087 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagcuugagtuaaacgaaca

SEQ ID NO: 1088 - RNA, 21 nt, Artificial Sequence
  source: /note="Description of Artificial Sequence: Synthetic oligonucleotide"
cgcacugaaacuuuucgucca

SEQ ID NO: 1089 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucggugacagtcacuagcuua

SEQ ID NO: 1090 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugcuaaugutauugguguca

SEQ ID NO: 1091 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcagacgtgtaaauguucca

SEQ ID NO: 1092 - RNA, 21 nt, Artificial Sequence
  source: /note="Description of Artificial Sequence: Synthetic oligonucleotide"
agagaagagacacauuguuga

SEQ ID NO: 1093 - RNA, 21 nt, Artificial Sequence
  source: /note="Description of Artificial Sequence: Synthetic oligonucleotide"
ugaaguucauggaugucuaua

SEQ ID NO: 1094 - RNA, 21 nt, Artificial Sequence
  source: /note="Description of Artificial Sequence: Synthetic oligonucleotide"
aauucuacauacuaaaucuca

SEQ ID NO: 1095 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagacgugtaaauguuccuga

SEQ ID NO: 1096 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacgaaguggtgaaguucaua

SEQ ID NO: 1097 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuugagutaaacgaacguaa

SEQ ID NO: 1098 - RNA, 21 nt, Artificial Sequence
  source: /note="Description of Artificial Sequence: Synthetic oligonucleotide"
caucuucaagccauccuguga

SEQ ID NO: 1099 - RNA, 21 nt, Artificial Sequence
  source: /note="Description of Artificial Sequence: Synthetic oligonucleotide"
caccaugcagauuaugcggaa

SEQ ID NO: 1100 - RNA, 21 nt, Artificial Sequence
  source: /note="Description of Artificial Sequence: Synthetic oligonucleotide"
ggcagcuugaguuaaacgaaa

SEQ ID NO: 1101 - RNA, 21 nt, Artificial Sequence
  source: /note="Description of Artificial Sequence: Synthetic oligonucleotide"
auguccucacaccauugaaaa

SEQ ID NO: 1102 - RNA, 21 nt, Artificial Sequence
  source: /note="Description of Artificial Sequence: Synthetic oligonucleotide"
ccgcagacguguaaauguuca

SEQ ID NO: 1103 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaaucatcacgaaguggua

SEQ ID NO: 1104 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugcuacugutuauccguaaa

SEQ ID NO: 1105 - RNA, 21 nt, Artificial Sequence
  source: /note="Description of Artificial Sequence: Synthetic oligonucleotide"
uguccucacaccauugaaaca

SEQ ID NO: 1106 - RNA, 21 nt, Artificial Sequence
  source: /note="Description of Artificial Sequence: Synthetic oligonucleotide"
cugcaaaaacacagacucgca

SEQ ID NO: 1107 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggcagctugaguuaaacga

SEQ ID NO: 1108 - RNA, 21 nt, Artificial Sequence
  source: /note="Description of Artificial Sequence: Synthetic oligonucleotide"
auccgcagacguguaaaugua

SEQ ID NO: 1109 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcauuugutuguacaagauca

SEQ ID NO: 1110 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaagcautuguuuguacaaa

SEQ ID NO: 1111 - RNA, 21 nt, Artificial Sequence
  source: /note="Description of Artificial Sequence: Synthetic oligonucleotide"
uggugcuacuguuuauccgua

SEQ ID NO: 1112 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcagcutgaguuaaacgaa

SEQ ID NO: 1113 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacugaaactuuucguccaa

SEQ ID NO: 1114 - RNA, 21 nt, Artificial Sequence
  source: /note="Description of Artificial Sequence: Synthetic oligonucleotide"
gacugauacagaacgaucgaa

SEQ ID NO: 1115 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgaacguactugcagaugua

SEQ ID NO: 1116 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcuugagutaaacgaacga

SEQ ID NO: 1117 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuugagtuaaacgaacgua

SEQ ID NO: 1118 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauauuaacatcacgucuuua

SEQ ID NO: 1119 - RNA, 21 nt, Artificial Sequence
  source: /note="Description of Artificial Sequence: Synthetic oligonucleotide"
ccugcaaaaacacagacucga

SEQ ID NO: 1120 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugcuggaautugauauucaa

SEQ ID NO: 1121 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggugcuactguuuauccga

SEQ ID NO: 1122 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuggugucutcacuggauga

SEQ ID NO: 1123 - RNA, 21 nt, Artificial Sequence
  source: /note="Description of Artificial Sequence: Synthetic oligonucleotide"
ucuugcugcuaaaucaccgaa

SEQ ID NO: 1124 - RNA, 21 nt, Artificial Sequence
  source: /note="Description of Artificial Sequence: Synthetic oligonucleotide"
uugcugcuaaaucaccgagca

SEQ ID NO: 1125 - RNA, 21 nt, Artificial Sequence
  source: /note="Description of Artificial Sequence: Synthetic oligonucleotide"
agauuaugcggaucaaaccua

SEQ ID NO: 1126 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggcagaatcaucacgaagua

SEQ ID NO: 1127 - RNA, 21 nt, Artificial Sequence
  source: /note="Description of Artificial Sequence: Synthetic oligonucleotide"
auuuguuuguacaagauccga

SEQ ID NO: 1128 - RNA, 21 nt, Artificial Sequence
  source: /note="Description of Artificial Sequence: Synthetic oligonucleotide"
caaaaacacagacucgcguua

SEQ ID NO: 1129 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuacugtutauccguaaua

SEQ ID NO: 1130 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuuuucgtccaacuucugga

SEQ ID NO: 1131 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggugcuactgtuuauccguaa

SEQ ID NO: 1132 - RNA, 21 nt, Artificial Sequence
  source: /note="Description of Artificial Sequence: Synthetic oligonucleotide"
gcaaaaacacagacucgcgua

SEQ ID NO: 1133 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgucgcactgaaacuuuucga

SEQ ID NO: 1134 - RNA, 21 nt, Artificial Sequence
  source: /note="Description of Artificial Sequence: Synthetic oligonucleotide"
auauuaacaucacgucuuuga

SEQ ID NO: 1135 - RNA, 21 nt, Artificial Sequence
  source: /note="Description of Artificial Sequence: Synthetic oligonucleotide"
aaaacacagacucgcguugca

SEQ ID NO: 1136 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugcagatgtgacaagccga

SEQ ID NO: 1137 - RNA, 21 nt, Artificial Sequence
  source: /note="Description of Artificial Sequence: Synthetic oligonucleotide"
uuuuuuuucaguauucuugga

SEQ ID NO: 1138 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagugagtgaccugcuuuua

SEQ ID NO: 1139 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucguccaactucugggcuga

SEQ ID NO: 1140 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggacauugctgugcuuugga

SEQ ID NO: 1141 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaucagutcgaggaaaggga

SEQ ID NO: 1142 - RNA, 21 nt, Artificial Sequence
  source: /note="Description of Artificial Sequence: Synthetic oligonucleotide"
uuccccaaaucacuguggaua

SEQ ID NO: 1143 - RNA, 21 nt, Artificial Sequence
  source: /note="Description of Artificial Sequence: Synthetic oligonucleotide"
cccucuuggaauuggauucga

SEQ ID NO: 1144 - RNA, 21 nt, Artificial Sequence
  source: /note="Description of Artificial Sequence: Synthetic oligonucleotide"
uugcagaugugacaagccgaa

SEQ ID NO: 1145 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacgucuutgtcucuagugca

SEQ ID NO: 1146 - RNA, 21 nt, Artificial Sequence
  source: /note="Description of Artificial Sequence: Synthetic oligonucleotide"
gauccgcagacguguaaauga

SEQ ID NO: 1147 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaaucagutcgaggaaaga

SEQ ID NO: 1148 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuguggactugaguuggga

SEQ ID NO: 1149 - RNA, 21 nt, Artificial Sequence
  source: /note="Description of Artificial Sequence: Synthetic oligonucleotide"
aaggggcaaaaacgaaagcga

SEQ ID NO: 1150 - RNA, 21 nt, Artificial Sequence
  source: /note="Description of Artificial Sequence: Synthetic oligonucleotide"
ugcaaaaacacagacucgcga

SEQ ID NO: 1151 - RNA, 21 nt, Artificial Sequence
  source: /note="Description of Artificial Sequence: Synthetic oligonucleotide"
acgucuuugucucuagugcaa

SEQ ID NO: 1152 - RNA, 21 nt, Artificial Sequence
  source: /note="Description of Artificial Sequence: Synthetic oligonucleotide"
gggcaaaaacgaaagcgcaaa

SEQ ID NO: 1153 - RNA, 21 nt, Artificial Sequence
  source: /note="Description of Artificial Sequence: Synthetic oligonucleotide"
aggggcaaaaacgaaagcgca

SEQ ID NO: 1154 - RNA, 21 nt, Artificial Sequence
  source: /note="Description of Artificial Sequence: Synthetic oligonucleotide"
gaaaaaaaaucaguucgagga

SEQ ID NO: 1155 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaucagtucgaggaaagga

SEQ ID NO: 1156 - RNA, 21 nt, Artificial Sequence
  source: /note="Description of Artificial Sequence: Synthetic oligonucleotide"
aaaaacacagacucgcguuga

SEQ ID NO: 1157 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuauccgtaauaauugugga

SEQ ID NO: 1158 - RNA, 21 nt, Artificial Sequence
  source: /note="Description of Artificial Sequence: Synthetic oligonucleotide"
agauccgcagacguguaaaua

SEQ ID NO: 1159 - RNA, 21 nt, Artificial Sequence
  source: /note="Description of Artificial Sequence: Synthetic oligonucleotide"
uuaacaucacgucuuugucua

SEQ ID NO: 1160 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgucuuugtctcuagugcaga

SEQ ID NO: 1161 - RNA, 21 nt, Artificial Sequence
  source: /note="Description of Artificial Sequence: Synthetic oligonucleotide"
guuuauccguaauaauuguga

SEQ ID NO: 1162 - RNA, 21 nt, Artificial Sequence
  source: /note="Description of Artificial Sequence: Synthetic oligonucleotide"
uuguuuguacaagauccgcaa

SEQ ID NO: 1163 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauccguaataauuguggga

SEQ ID NO: 1164 - RNA, 21 nt, Artificial Sequence
  source: /note="Description of Artificial Sequence: Synthetic oligonucleotide"
aacacagacucgcguugcaaa

SEQ ID NO: 1165 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuuucagtauucuuggua

SEQ ID NO: 1166 - RNA, 21 nt, Artificial Sequence
  source: /note="Description of Artificial Sequence: Synthetic oligonucleotide"
auuaacaucacgucuuuguca

SEQ ID NO: 1167 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagaauagcaatgtctauuuuau

SEQ ID NO: 1168 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacaccaauaacatuagcacugu

SEQ ID NO: 1169 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtatcgaucgtucuguauca

SEQ ID NO: 1170 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauucacauuugutgtgcuguag

SEQ ID NO: 1171 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaucgaucgutctgtaucaguc

SEQ ID NO: 1172 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucguauauaaaacactuucucuu

SEQ ID NO: 1173 - RNA, 23 nt, Artificial Sequence
  source: /note="Description of Artificial Sequence: Synthetic oligonucleotide"
ugauacaucucauaaauaguuga

SEQ ID NO: 1174 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaucgtucugtatcagucuuuc

SEQ ID NO: 1175 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutaguaugtagaauucucua

SEQ ID NO: 1176 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucgutcuguaucagucuuucc

SEQ ID NO: 1177 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggatatuaaataagtaccguau

SEQ ID NO: 1178 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucgatcguucuguaucagucu

SEQ ID NO: 1179 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugautaaggactgtucugucgau

SEQ ID NO: 1180 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuggatuaaggacuguucuguc

SEQ ID NO: 1181 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaauaacautagcacuguuaa

SEQ ID NO: 1182 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaagataagctagugacuguca

SEQ ID NO: 1183 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucucggtgauutagcagcaagaa

SEQ ID NO: 1184 - RNA, 23 nt, Artificial Sequence
  source: /note="Description of Artificial Sequence: Synthetic oligonucleotide"
uaccguauauaaaacacuuucuc

SEQ ID NO: 1185 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaccggtacaaauaagagagcaa

SEQ ID NO: 1186 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggtgauuuagcagcaagaaaa

SEQ ID NO: 1187 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaactaguggutucaauggugug

SEQ ID NO: 1188 - RNA, 23 nt, Artificial Sequence
  source: /note="Description of Artificial Sequence: Synthetic oligonucleotide"
ugggauauuaaauaaguaccgua

SEQ ID NO: 1189 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauacatcucataaataguugaa

SEQ ID NO: 1190 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucautucaggutucuggauuaag

SEQ ID NO: 1191 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagaatagcaaugucuauuuua

SEQ ID NO: 1192 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuuguacaaacaaatgcuuucu

SEQ ID NO: 1193 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauggcgaauccaautccaagag

SEQ ID NO: 1194 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuagtgguutcaatgguguga

SEQ ID NO: 1195 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauaaucugcatggugauguugg

SEQ ID NO: 1196 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagataagcuagugacugucacc

SEQ ID NO: 1197 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaagtacgutcgutuaacuca

SEQ ID NO: 1198 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagatacaucucataaauaguug

SEQ ID NO: 1199 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugcaaguacgutcguuuaacu

SEQ ID NO: 1200 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagggatauuaaataaguaccgu

SEQ ID NO: 1201 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccatgaacuucaccacuucgug

SEQ ID NO: 1202 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtgaagacaccaauaacauu

SEQ ID NO: 1203 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggtacaaauaagagagcaaga

SEQ ID NO: 1204 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauaagtaccgtatataaaacac

SEQ ID NO: 1205 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtcaaauacatccagugaag

SEQ ID NO: 1206 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaagutcauggutucggaggcc

SEQ ID NO: 1207 - RNA, 23 nt, Artificial Sequence
  source: /note="Description of Artificial Sequence: Synthetic oligonucleotide"
uauccagugaagacaccaauaac

SEQ ID NO: 1208 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgatcguucuguaucagucuuu

SEQ ID NO: 1209 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacautuacacgtctgcggauc

SEQ ID NO: 1210 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaaguacguucgtutaacucaa

SEQ ID NO: 1211 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccgtatauaaaacacuuucucu

SEQ ID NO: 1212 - RNA, 23 nt, Artificial Sequence
  source: /note="Description of Artificial Sequence: Synthetic oligonucleotide"
uccagugaagacaccaauaacau

SEQ ID NO: 1213 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguacgtucgutuaacucaagcu

SEQ ID NO: 1214 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagtacguucgutuaacucaag

SEQ ID NO: 1215 - RNA, 23 nt, Artificial Sequence
  source: /note="Description of Artificial Sequence: Synthetic oligonucleotide"
ucgcauaaucugcauggugaugu

SEQ ID NO: 1216 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaguacguucgtutaacucaagc

SEQ ID NO: 1217 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguucgtuuaacucaagcugccu

SEQ ID NO: 1218 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggacgaaaagtutcagugcgac

SEQ ID NO: 1219 - RNA, 23 nt, Artificial Sequence
  source: /note="Description of Artificial Sequence: Synthetic oligonucleotide"
uaagcuagugacugucaccgauc

SEQ ID NO: 1220 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugacaccaauaacautagcacug

SEQ ID NO: 1221 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggaacauuuacacgtcugcgga

SEQ ID NO: 1222 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaacaaugugtctctucucuuc

SEQ ID NO: 1223 - RNA, 23 nt, Artificial Sequence
  source: /note="Description of Artificial Sequence: Synthetic oligonucleotide"
uauagacauccaugaacuucacc

SEQ ID NO: 1224 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagautuaguauguagaauucu

SEQ ID NO: 1225 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaggaacauutacacgucugcg

SEQ ID NO: 1226 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugaacuucaccactucgugau

SEQ ID NO: 1227 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utacgutcguutaactcaagcug

SEQ ID NO: 1228 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacaggauggcutgaagaugua

SEQ ID NO: 1229 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utccgcauaaucugcauggugau

SEQ ID NO: 1230 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utucgutuaactcaagcugccuc

SEQ ID NO: 1231 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuucaauggugugaggacauag

SEQ ID NO: 1232 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaacatuuacacgucugcggau

SEQ ID NO: 1233 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaccactucgugatgauucugcc

SEQ ID NO: 1234 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuacggauaaacagtagcacca

SEQ ID NO: 1235 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguutcaauggtgtgaggacaua

SEQ ID NO: 1236 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcgagtcugugututugcagga

SEQ ID NO: 1237 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgutuaacucaagctgccucgc

SEQ ID NO: 1238 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacatutacacgucugcggaucu

SEQ ID NO: 1239 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaucutguacaaacaaaugcuu

SEQ ID NO: 1240 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugtacaaacaaaugcuuucuc

SEQ ID NO: 1241 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggataaacagtagcaccaau

SEQ ID NO: 1242 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcgtutaacucaagcugccucg

SEQ ID NO: 1243 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggacgaaaagutucagugcga

SEQ ID NO: 1244 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcgaucguuctgtatcagucuu

SEQ ID NO: 1245 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacatctgcaaguacguucguuu

SEQ ID NO: 1246 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgutcguuuaactcaagcugcc

SEQ ID NO: 1247 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgtucguuuaacucaagcugc

SEQ ID NO: 1248 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaagacgugatgtuaauaucuu

SEQ ID NO: 1249 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgagucugugtututgcaggaa

SEQ ID NO: 1250 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgaauaucaaautccagcaccg

SEQ ID NO: 1251 - RNA, 23 nt, Artificial Sequence
  source: /note="Description of Artificial Sequence: Synthetic oligonucleotide"
ucggauaaacaguagcaccaaua

SEQ ID NO: 1252 - RNA, 23 nt, Artificial Sequence
  source: /note="Description of Artificial Sequence: Synthetic oligonucleotide"
ucauccagugaagacaccaauaa

SEQ ID NO: 1253 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcggugauuuagcagcaagaaa

SEQ ID NO: 1254 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcucggugautuagcagcaaga

SEQ ID NO: 1255 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaggtutgauccgcataaucugc

SEQ ID NO: 1256 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacutcgugaugatucugcccuc

SEQ ID NO: 1257 - RNA, 23 nt, Artificial Sequence
  source: /note="Description of Artificial Sequence: Synthetic oligonucleotide"
ucggaucuuguacaaacaaaugc

SEQ ID NO: 1258 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacgcgaguctgtgtuuuugca

SEQ ID NO: 1259 - RNA, 23 nt, Artificial Sequence
  source: /note="Description of Artificial Sequence: Synthetic oligonucleotide"
uauuacggauaaacaguagcacc

SEQ ID NO: 1260 - RNA, 23 nt, Artificial Sequence
  source: /note="Description of Artificial Sequence: Synthetic oligonucleotide"
uccagaaguuggacgaaaaguuu

SEQ ID NO: 1261 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utacggauaaacaguagcaccaa

SEQ ID NO: 1262 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgcgagucugugutuuugcag

SEQ ID NO: 1263 - RNA, 23 nt, Artificial Sequence
  source: /note="Description of Artificial Sequence: Synthetic oligonucleotide"
ucgaaaaguuucagugcgacgcc

SEQ ID NO: 1264 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaaagacgugaugutaauaucu

SEQ ID NO: 1265 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaacgcgagtctgtguuuuug

SEQ ID NO: 1266 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggcutgucacatctgcaagua

SEQ ID NO: 1267 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaagaauactgaaaaaaaacc

SEQ ID NO: 1268 - RNA, 23 nt, Artificial Sequence
  source: /note="Description of Artificial Sequence: Synthetic oligonucleotide"
uaaaagcaggucacucacuuugc

SEQ ID NO: 1269 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagcccagaagutggacgaaaa

SEQ ID NO: 1270 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaaagcacagcaatguccuga

SEQ ID NO: 1271 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccctutccucgaactgauuuuu

SEQ ID NO: 1272 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauccacagugautuggggaagu

SEQ ID NO: 1273 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgaauccaautccaagagggac

SEQ ID NO: 1274 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcggctugucacaucugcaagu

SEQ ID NO: 1275 - RNA, 23 nt, Artificial Sequence
  source: /note="Description of Artificial Sequence: Synthetic oligonucleotide"
ugcacuagagacaaagacgugau

SEQ ID NO: 1276 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucautuacacgtctgcggaucuu

SEQ ID NO: 1277 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuutccucgaactgauuuuuuu

SEQ ID NO: 1278 - RNA, 23 nt, Artificial Sequence
  source: /note="Description of Artificial Sequence: Synthetic oligonucleotide"
ucccaacucaaguccacagcagu

SEQ ID NO: 1279 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgctutcguututgccccuuuc

SEQ ID NO: 1280 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgcgagucugtgtutuugcagg

SEQ ID NO: 1281 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgcactagagacaaagacguga

SEQ ID NO: 1282 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugcgcuuucgututugccccu

SEQ ID NO: 1283 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcgcutucgututugccccuuu

SEQ ID NO: 1284 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccucgaacugaututuuuucuu

SEQ ID NO: 1285 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccutuccucgaacugauuuuuu

SEQ ID NO: 1286 - RNA, 23 nt, Artificial Sequence
  source: /note="Description of Artificial Sequence: Synthetic oligonucleotide"
ucaacgcgagucuguguuuuugc

SEQ ID NO: 1287 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccacaauuautacggauaaaca

SEQ ID NO: 1288 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutacacgucugcggaucuug

SEQ ID NO: 1289 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagacaaagacgugatguuaaua

SEQ ID NO: 1290 - RNA, 23 nt, Artificial Sequence
  source: /note="Description of Artificial Sequence: Synthetic oligonucleotide"
ucugcacuagagacaaagacgug

SEQ ID NO: 1291 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacaatuauuacggauaaacag

SEQ ID NO: 1292 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgcggaucuuguacaaacaaau

SEQ ID NO: 1293 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucccacaauuatuacggauaaac

SEQ ID NO: 1294 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugcaacgcgagtctguguuuu

SEQ ID NO: 1295 - RNA, 23 nt, Artificial Sequence
  source: /note="Description of Artificial Sequence: Synthetic oligonucleotide"
uaccaagaauacugaaaaaaaac

SEQ ID NO: 1296 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugacaaagacgtgauguuaauau

SEQ ID NO: 1297 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaauagacatugcuauucua

SEQ ID NO: 1298 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugcuaatgtuauuggugua

SEQ ID NO: 1299 - RNA, 21 nt, Artificial Sequence
  source: /note="Description of Artificial Sequence: Synthetic oligonucleotide"
auacagaacgaucgauacaga

SEQ ID NO: 1300 - RNA, 21 nt, Artificial Sequence
  source: /note="Description of Artificial Sequence: Synthetic oligonucleotide"
acagcacaacaaaugugaaua

SEQ ID NO: 1301 - RNA, 21 nt, Artificial Sequence
  source: /note="Description of Artificial Sequence: Synthetic oligonucleotide"
cugauacagaacgaucgauaa

SEQ ID NO: 1302 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagaaagugutuuauauacga

SEQ ID NO: 1303 - RNA, 21 nt, Artificial Sequence
  source: /note="Description of Artificial Sequence: Synthetic oligonucleotide"
aacuauuuaugagauguauca

SEQ ID NO: 1304 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagacugatacagaacgauca

SEQ ID NO: 1305 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagaauuctacauacuaaaua

SEQ ID NO: 1306 - RNA, 21 nt, Artificial Sequence
  source: /note="Description of Artificial Sequence: Synthetic oligonucleotide"
aaagacugauacagaacgaua

SEQ ID NO: 1307 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgguacutatuuaauaucca

SEQ ID NO: 1308 - RNA, 21 nt, Artificial Sequence
  source: /note="Description of Artificial Sequence: Synthetic oligonucleotide"
acugauacagaacgaucgaua

SEQ ID NO: 1309 - RNA, 21 nt, Artificial Sequence
  source: /note="Description of Artificial Sequence: Synthetic oligonucleotide"
cgacagaacaguccuuaauca

SEQ ID NO: 1310 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaacagtccuuaauccaga

SEQ ID NO: 1311 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacagugctaauguuauugga

SEQ ID NO: 1312 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagucactagcuuaucuuga

SEQ ID NO: 1313 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugcugctaaaucaccgaga

SEQ ID NO: 1314 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaagugututauauacggua

SEQ ID NO: 1315 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcucucuuautuguaccggua

SEQ ID NO: 1316 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuugcugctaaaucaccga

SEQ ID NO: 1317 - RNA, 21 nt, Artificial Sequence
  source: /note="Description of Artificial Sequence: Synthetic oligonucleotide"
caccauugaaaccacuaguua

SEQ ID NO: 1318 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgguacuuautuaauauccca

SEQ ID NO: 1319 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caacuauutatgagauguaua

SEQ ID NO: 1320 - RNA, 21 nt, Artificial Sequence
  source: /note="Description of Artificial Sequence: Synthetic oligonucleotide"
uaauccagaaaccugaaauga

SEQ ID NO: 1321 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaauagacautgcuauucuga

SEQ ID NO: 1322 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagcauutgtuuguacaaga

SEQ ID NO: 1323 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuggaautggauucgccaua

SEQ ID NO: 1324 - RNA, 21 nt, Artificial Sequence
  source: /note="Description of Artificial Sequence: Synthetic oligonucleotide"
acaccauugaaaccacuagua

SEQ ID NO: 1325 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaucaccatgcagauuaua

SEQ ID NO: 1326 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugacagucactagcuuaucua

SEQ ID NO: 1327 - RNA, 21 nt, Artificial Sequence
  source: /note="Description of Artificial Sequence: Synthetic oligonucleotide"
aguuaaacgaacguacuugca

SEQ ID NO: 1328 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuauuuatgagauguaucua

SEQ ID NO: 1329 - RNA, 21 nt, Artificial Sequence
  source: /note="Description of Artificial Sequence: Synthetic oligonucleotide"
uuaaacgaacguacuugcaga

SEQ ID NO: 1330 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguacuuatutaauaucccua

SEQ ID NO: 1331 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgaaguggtgaaguucaugga

SEQ ID NO: 1332 - RNA, 21 nt, Artificial Sequence
  source: /note="Description of Artificial Sequence: Synthetic oligonucleotide"
uguuauuggugucuucacuga

SEQ ID NO: 1333 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcucuctuauuuguaccga

SEQ ID NO: 1334 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuuuauatacgguacuuaua

SEQ ID NO: 1335 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacuggatgtauuugacuga

SEQ ID NO: 1336 - RNA, 21 nt, Artificial Sequence
  source: /note="Description of Artificial Sequence: Synthetic oligonucleotide"
ccuccgaaaccaugaacuuua

SEQ ID NO: 1337 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuggugtctucacuggaua

SEQ ID NO: 1338 - RNA, 21 nt, Artificial Sequence
  source: /note="Description of Artificial Sequence: Synthetic oligonucleotide"
agacugauacagaacgaucga

SEQ ID NO: 1339 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgcagacgtguaaauguua

SEQ ID NO: 1340 - RNA, 21 nt, Artificial Sequence
  source: /note="Description of Artificial Sequence: Synthetic oligonucleotide"
gaguuaaacgaacguacuuga

SEQ ID NO: 1341 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaagugtutuauauacgga

SEQ ID NO: 1342 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuauuggtgtcuucacugga

SEQ ID NO: 1343 - RNA, 21 nt, Artificial Sequence
  source: /note="Description of Artificial Sequence: Synthetic oligonucleotide"
cuugaguuaaacgaacguaca

SEQ ID NO: 1344 - RNA, 21 nt, Artificial Sequence
  source: /note="Description of Artificial Sequence: Synthetic oligonucleotide"
ugaguuaaacgaacguacuua

SEQ ID NO: 1345 - RNA, 21 nt, Artificial Sequence
  source: /note="Description of Artificial Sequence: Synthetic oligonucleotide"
aucaccaugcagauuaugcga

SEQ ID NO: 1346 - RNA, 21 nt, Artificial Sequence
  source: /note="Description of Artificial Sequence: Synthetic oligonucleotide"
uugaguuaaacgaacguacua

SEQ ID NO: 1347 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagcuugagtuaaacgaaca

SEQ ID NO: 1348 - RNA, 21 nt, Artificial Sequence
  source: /note="Description of Artificial Sequence: Synthetic oligonucleotide"
cgcacugaaacuuuucgucca

SEQ ID NO: 1349 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucggugacagtcacuagcuua

SEQ ID NO: 1350 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugcuaaugutauugguguca

SEQ ID NO: 1351 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcagacgtgtaaauguucca

SEQ ID NO: 1352 - RNA, 21 nt, Artificial Sequence
  source: /note="Description of Artificial Sequence: Synthetic oligonucleotide"
agagaagagacacauuguuga

SEQ ID NO: 1353 - RNA, 21 nt, Artificial Sequence
  source: /note="Description of Artificial Sequence: Synthetic oligonucleotide"
ugaaguucauggaugucuaua

SEQ ID NO: 1354 - RNA, 21 nt, Artificial Sequence
  source: /note="Description of Artificial Sequence: Synthetic oligonucleotide"
aauucuacauacuaaaucuca

SEQ ID NO: 1355 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagacgugtaaauguuccuga

SEQ ID NO: 1356 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacgaaguggtgaaguucaua

SEQ ID NO: 1357 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuugagutaaacgaacguaa

SEQ ID NO: 1358 - RNA, 21 nt, Artificial Sequence
  source: /note="Description of Artificial Sequence: Synthetic oligonucleotide"
caucuucaagccauccuguga

SEQ ID NO: 1359 - RNA, 21 nt, Artificial Sequence
  source: /note="Description of Artificial Sequence: Synthetic oligonucleotide"
caccaugcagauuaugcggaa

SEQ ID NO: 1360 - RNA, 21 nt, Artificial Sequence
  source: /note="Description of Artificial Sequence: Synthetic oligonucleotide"
ggcagcuugaguuaaacgaaa

SEQ ID NO: 1361 - RNA, 21 nt, Artificial Sequence
  source: /note="Description of Artificial Sequence: Synthetic oligonucleotide"
auguccucacaccauugaaaa

SEQ ID NO: 1362 - RNA, 21 nt, Artificial Sequence
  source: /note="Description of Artificial Sequence: Synthetic oligonucleotide"
ccgcagacguguaaauguuca

SEQ ID NO: 1363 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaaucatcacgaaguggua

SEQ ID NO: 1364 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugcuacugutuauccguaaa

SEQ ID NO: 1365 - RNA, 21 nt, Artificial Sequence
  source: /note="Description of Artificial Sequence: Synthetic oligonucleotide"
uguccucacaccauugaaaca

SEQ ID NO: 1366 - RNA, 21 nt, Artificial Sequence
  source: /note="Description of Artificial Sequence: Synthetic oligonucleotide"
cugcaaaaacacagacucgca

SEQ ID NO: 1367 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggcagctugaguuaaacga

SEQ ID NO: 1368 - RNA, 21 nt, Artificial Sequence
  source: /note="Description of Artificial Sequence: Synthetic oligonucleotide"
auccgcagacguguaaaugua

SEQ ID NO: 1369 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcauuugutuguacaagauca

SEQ ID NO: 1370 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaagcautuguuuguacaaa

SEQ ID NO: 1371 - RNA, 21 nt, Artificial Sequence
  source: /note="Description of Artificial Sequence: Synthetic oligonucleotide"
uggugcuacuguuuauccgua

SEQ ID NO: 1372 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcagcutgaguuaaacgaa

SEQ ID NO: 1373 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacugaaactuuucguccaa

SEQ ID NO: 1374 - RNA, 21 nt, Artificial Sequence
  source: /note="Description of Artificial Sequence: Synthetic oligonucleotide"
gacugauacagaacgaucgaa

SEQ ID NO: 1375 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgaacguactugcagaugua

SEQ ID NO: 1376 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcuugagutaaacgaacga

SEQ ID NO: 1377 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuugagtuaaacgaacgua

SEQ ID NO: 1378 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauauuaacatcacgucuuua

SEQ ID NO: 1379 - RNA, 21 nt, Artificial Sequence
  source: /note="Description of Artificial Sequence: Synthetic oligonucleotide"
ccugcaaaaacacagacucga

SEQ ID NO: 1380 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugcuggaautugauauucaa

SEQ ID NO: 1381 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggugcuactguuuauccga

SEQ ID NO: 1382 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuggugucutcacuggauga

SEQ ID NO: 1383 - RNA, 21 nt, Artificial Sequence
  source: /note="Description of Artificial Sequence: Synthetic oligonucleotide"
ucuugcugcuaaaucaccgaa

SEQ ID NO: 1384 - RNA, 21 nt, Artificial Sequence
  source: /note="Description of Artificial Sequence: Synthetic oligonucleotide"
uugcugcuaaaucaccgagca

SEQ ID NO: 1385 - RNA, 21 nt, Artificial Sequence
  source: /note="Description of Artificial Sequence: Synthetic oligonucleotide"
agauuaugcggaucaaaccua

SEQ ID NO: 1386 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggcagaatcaucacgaagua

SEQ ID NO: 1387 - RNA, 21 nt, Artificial Sequence
  source: /note="Description of Artificial Sequence: Synthetic oligonucleotide"
auuuguuuguacaagauccga

SEQ ID NO: 1388 - RNA, 21 nt, Artificial Sequence
  source: /note="Description of Artificial Sequence: Synthetic oligonucleotide"
caaaaacacagacucgcguua

SEQ ID NO: 1389 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuacugtutauccguaaua

SEQ ID NO: 1390 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuuuucgtccaacuucugga

SEQ ID NO: 1391 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggugcuactgtuuauccguaa

SEQ ID NO: 1392 - RNA, 21 nt, Artificial Sequence
  source: /note="Description of Artificial Sequence: Synthetic oligonucleotide"
gcaaaaacacagacucgcgua

SEQ ID NO: 1393 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgucgcactgaaacuuuucga

SEQ ID NO: 1394 - RNA, 21 nt, Artificial Sequence
  source: /note="Description of Artificial Sequence: Synthetic oligonucleotide"
auauuaacaucacgucuuuga

SEQ ID NO: 1395 - RNA, 21 nt, Artificial Sequence
  source: /note="Description of Artificial Sequence: Synthetic oligonucleotide"
aaaacacagacucgcguugca

SEQ ID NO: 1396 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugcagatgtgacaagccga

SEQ ID NO: 1397 - RNA, 21 nt, Artificial Sequence
  source: /note="Description of Artificial Sequence: Synthetic oligonucleotide"
uuuuuuuucaguauucuugga

SEQ ID NO: 1398 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagugagtgaccugcuuuua

SEQ ID NO: 1399 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucguccaactucugggcuga

SEQ ID NO: 1400 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggacauugctgugcuuugga

SEQ ID NO: 1401 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaucagutcgaggaaaggga

SEQ ID NO: 1402 - RNA, 21 nt, Artificial Sequence
  source: /note="Description of Artificial Sequence: Synthetic oligonucleotide"
uuccccaaaucacuguggaua

SEQ ID NO: 1403 - RNA, 21 nt, Artificial Sequence
  source: /note="Description of Artificial Sequence: Synthetic oligonucleotide"
cccucuuggaauuggauucga

SEQ ID NO: 1404 - RNA, 21 nt, Artificial Sequence
  source: /note="Description of Artificial Sequence: Synthetic oligonucleotide"
uugcagaugugacaagccgaa

SEQ ID NO: 1405 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacgucuutgtcucuagugca

SEQ ID NO: 1406 - RNA, 21 nt, Artificial Sequence
  source: /note="Description of Artificial Sequence: Synthetic oligonucleotide"
gauccgcagacguguaaauga

SEQ ID NO: 1407 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaaucagutcgaggaaaga

SEQ ID NO: 1408 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuguggactugaguuggga

SEQ ID NO: 1409 - RNA, 21 nt, Artificial Sequence
  source: /note="Description of Artificial Sequence: Synthetic oligonucleotide"
aaggggcaaaaacgaaagcga

SEQ ID NO: 1410 - RNA, 21 nt, Artificial Sequence
  source: /note="Description of Artificial Sequence: Synthetic oligonucleotide"
ugcaaaaacacagacucgcga

SEQ ID NO: 1411 - RNA, 21 nt, Artificial Sequence
  source: /note="Description of Artificial Sequence: Synthetic oligonucleotide"
acgucuuugucucuagugcaa

SEQ ID NO: 1412 - RNA, 21 nt, Artificial Sequence
  source: /note="Description of Artificial Sequence: Synthetic oligonucleotide"
gggcaaaaacgaaagcgcaaa

SEQ ID NO: 1413 - RNA, 21 nt, Artificial Sequence
  source: /note="Description of Artificial Sequence: Synthetic oligonucleotide"
aggggcaaaaacgaaagcgca

SEQ ID NO: 1414 - RNA, 21 nt, Artificial Sequence
  source: /note="Description of Artificial Sequence: Synthetic oligonucleotide"
gaaaaaaaaucaguucgagga

SEQ ID NO: 1415 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaucagtucgaggaaagga

SEQ ID NO: 1416 - RNA, 21 nt, Artificial Sequence
  source: /note="Description of Artificial Sequence: Synthetic oligonucleotide"
aaaaacacagacucgcguuga

SEQ ID NO: 1417 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuauccgtaauaauugugga

SEQ ID NO: 1418 - RNA, 21 nt, Artificial Sequence
  source: /note="Description of Artificial Sequence: Synthetic oligonucleotide"
agauccgcagacguguaaaua

SEQ ID NO: 1419 - RNA, 21 nt, Artificial Sequence
  source: /note="Description of Artificial Sequence: Synthetic oligonucleotide"
uuaacaucacgucuuugucua

SEQ ID NO: 1420 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgucuuugtctcuagugcaga

SEQ ID NO: 1421 - RNA, 21 nt, Artificial Sequence
  source: /note="Description of Artificial Sequence: Synthetic oligonucleotide"
guuuauccguaauaauuguga

SEQ ID NO: 1422 - RNA, 21 nt, Artificial Sequence
  source: /note="Description of Artificial Sequence: Synthetic oligonucleotide"
uuguuuguacaagauccgcaa

SEQ ID NO: 1423 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauccguaataauuguggga

SEQ ID NO: 1424 - RNA, 21 nt, Artificial Sequence
  source: /note="Description of Artificial Sequence: Synthetic oligonucleotide"
aacacagacucgcguugcaaa

SEQ ID NO: 1425 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuuucagtauucuuggua

SEQ ID NO: 1426 - RNA, 21 nt, Artificial Sequence
  source: /note="Description of Artificial Sequence: Synthetic oligonucleotide"
auuaacaucacgucuuuguca

SEQ ID NO: 1427 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagaauagcaatgtctauuuuau

SEQ ID NO: 1428 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacaccaauaacatuagcacugu

SEQ ID NO: 1429 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtatcgaucgtucuguauca

SEQ ID NO: 1430 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauucacauuugutgtgcuguag

SEQ ID NO: 1431 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaucgaucgutctgtaucaguc

SEQ ID NO: 1432 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucguauauaaaacactuucucuu

SEQ ID NO: 1433 - RNA, 23 nt, Artificial Sequence
  source: /note="Description of Artificial Sequence: Synthetic oligonucleotide"
ugauacaucucauaaauaguuga

SEQ ID NO: 1434 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaucgtucugtatcagucuuuc

SEQ ID NO: 1435 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutaguaugtagaauucucua

SEQ ID NO: 1436 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucgutcuguaucagucuuucc

SEQ ID NO: 1437 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggatatuaaataagtaccguau

SEQ ID NO: 1438 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucgatcguucuguaucagucu

SEQ ID NO: 1439 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugautaaggactgtucugucgau

SEQ ID NO: 1440 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuggatuaaggacuguucuguc

SEQ ID NO: 1441 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaauaacautagcacuguuaa

SEQ ID NO: 1442 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaagataagctagugacuguca

SEQ ID NO: 1443 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucucggtgauutagcagcaagaa

SEQ ID NO: 1444 - RNA, 23 nt, Artificial Sequence
  source: /note="Description of Artificial Sequence: Synthetic oligonucleotide"
uaccguauauaaaacacuuucuc

SEQ ID NO: 1445 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaccggtacaaauaagagagcaa

SEQ ID NO: 1446 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggtgauuuagcagcaagaaaa

SEQ ID NO: 1447 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaactaguggutucaauggugug

SEQ ID NO: 1448 - RNA, 23 nt, Artificial Sequence
  source: /note="Description of Artificial Sequence: Synthetic oligonucleotide"
ugggauauuaaauaaguaccgua

SEQ ID NO: 1449 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauacatcucataaataguugaa

SEQ ID NO: 1450 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucautucaggutucuggauuaag

SEQ ID NO: 1451 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagaatagcaaugucuauuuua

SEQ ID NO: 1452 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuuguacaaacaaatgcuuucu

SEQ ID NO: 1453 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauggcgaauccaautccaagag

SEQ ID NO: 1454 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuagtgguutcaatgguguga

SEQ ID NO: 1455 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauaaucugcatggugauguugg

SEQ ID NO: 1456 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagataagcuagugacugucacc

SEQ ID NO: 1457 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaagtacgutcgutuaacuca

SEQ ID NO: 1458 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagatacaucucataaauaguug

SEQ ID NO: 1459 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugcaaguacgutcguuuaacu

SEQ ID NO: 1460 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagggatauuaaataaguaccgu

SEQ ID NO: 1461 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccatgaacuucaccacuucgug

SEQ ID NO: 1462 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtgaagacaccaauaacauu

SEQ ID NO: 1463 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggtacaaauaagagagcaaga

SEQ ID NO: 1464 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauaagtaccgtatataaaacac

SEQ ID NO: 1465 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtcaaauacatccagugaag

SEQ ID NO: 1466 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaagutcauggutucggaggcc

SEQ ID NO: 1467 - RNA, 23 nt, Artificial Sequence
  source: /note="Description of Artificial Sequence: Synthetic oligonucleotide"
uauccagugaagacaccaauaac

SEQ ID NO: 1468 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgatcguucuguaucagucuuu

SEQ ID NO: 1469 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacautuacacgtctgcggauc

SEQ ID NO: 1470 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaaguacguucgtutaacucaa

SEQ ID NO: 1471 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccgtatauaaaacacuuucucu

SEQ ID NO: 1472 - RNA, 23 nt, Artificial Sequence
  source: /note="Description of Artificial Sequence: Synthetic oligonucleotide"
uccagugaagacaccaauaacau

SEQ ID NO: 1473 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguacgtucgutuaacucaagcu

SEQ ID NO: 1474 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagtacguucgutuaacucaag

SEQ ID NO: 1475 - RNA, 23 nt, Artificial Sequence
  source: /note="Description of Artificial Sequence: Synthetic oligonucleotide"
ucgcauaaucugcauggugaugu

SEQ ID NO: 1476 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaguacguucgtutaacucaagc

SEQ ID NO: 1477 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguucgtuuaacucaagcugccu

SEQ ID NO: 1478 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggacgaaaagtutcagugcgac

SEQ ID NO: 1479 - RNA, 23 nt, Artificial Sequence
  source: /note="Description of Artificial Sequence: Synthetic oligonucleotide"
uaagcuagugacugucaccgauc

SEQ ID NO: 1480 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugacaccaauaacautagcacug

SEQ ID NO: 1481 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggaacauuuacacgtcugcgga

SEQ ID NO: 1482 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaacaaugugtctctucucuuc

SEQ ID NO: 1483 - RNA, 23 nt, Artificial Sequence
  source: /note="Description of Artificial Sequence: Synthetic oligonucleotide"
uauagacauccaugaacuucacc

SEQ ID NO: 1484 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagautuaguauguagaauucu

SEQ ID NO: 1485 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaggaacauutacacgucugcg

SEQ ID NO: 1486 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugaacuucaccactucgugau

SEQ ID NO: 1487 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utacgutcguutaactcaagcug

SEQ ID NO: 1488 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacaggauggcutgaagaugua

SEQ ID NO: 1489 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utccgcauaaucugcauggugau

SEQ ID NO: 1490 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utucgutuaactcaagcugccuc

SEQ ID NO: 1491 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuucaauggugugaggacauag

SEQ ID NO: 1492 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaacatuuacacgucugcggau

SEQ ID NO: 1493 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaccactucgugatgauucugcc

SEQ ID NO: 1494 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuacggauaaacagtagcacca

SEQ ID NO: 1495 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguutcaauggtgtgaggacaua

SEQ ID NO: 1496 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcgagtcugugututugcagga

SEQ ID NO: 1497 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgutuaacucaagctgccucgc

SEQ ID NO: 1498 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacatutacacgucugcggaucu

SEQ ID NO: 1499 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaucutguacaaacaaaugcuu

SEQ ID NO: 1500 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugtacaaacaaaugcuuucuc

SEQ ID NO: 1501 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggataaacagtagcaccaau

SEQ ID NO: 1502 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcgtutaacucaagcugccucg

SEQ ID NO: 1503 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggacgaaaagutucagugcga

SEQ ID NO: 1504 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcgaucguuctgtatcagucuu

SEQ ID NO: 1505 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacatctgcaaguacguucguuu

SEQ ID NO: 1506 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgutcguuuaactcaagcugcc

SEQ ID NO: 1507 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgtucguuuaacucaagcugc

SEQ ID NO: 1508 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaagacgugatgtuaauaucuu

SEQ ID NO: 1509 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgagucugugtututgcaggaa

SEQ ID NO: 1510 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgaauaucaaautccagcaccg

SEQ ID NO: 1511 - RNA, 23 nt, Artificial Sequence
  source: /note="Description of Artificial Sequence: Synthetic oligonucleotide"
ucggauaaacaguagcaccaaua

SEQ ID NO: 1512 - RNA, 23 nt, Artificial Sequence
  source: /note="Description of Artificial Sequence: Synthetic oligonucleotide"
ucauccagugaagacaccaauaa

SEQ ID NO: 1513 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcggugauuuagcagcaagaaa

SEQ ID NO: 1514 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcucggugautuagcagcaaga

SEQ ID NO: 1515 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaggtutgauccgcataaucugc

SEQ ID NO: 1516 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacutcgugaugatucugcccuc

SEQ ID NO: 1517 - RNA, 23 nt, Artificial Sequence
  source: /note="Description of Artificial Sequence: Synthetic oligonucleotide"
ucggaucuuguacaaacaaaugc

SEQ ID NO: 1518 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacgcgaguctgtgtuuuugca

SEQ ID NO: 1519 - RNA, 23 nt, Artificial Sequence
  source: /note="Description of Artificial Sequence: Synthetic oligonucleotide"
uauuacggauaaacaguagcacc

SEQ ID NO: 1520 - RNA, 23 nt, Artificial Sequence
  source: /note="Description of Artificial Sequence: Synthetic oligonucleotide"
uccagaaguuggacgaaaaguuu

SEQ ID NO: 1521 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utacggauaaacaguagcaccaa

SEQ ID NO: 1522 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgcgagucugugutuuugcag

SEQ ID NO: 1523 - RNA, 23 nt, Artificial Sequence
  source: /note="Description of Artificial Sequence: Synthetic oligonucleotide"
ucgaaaaguuucagugcgacgcc

SEQ ID NO: 1524 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaaagacgugaugutaauaucu

SEQ ID NO: 1525 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaacgcgagtctgtguuuuug

SEQ ID NO: 1526 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggcutgucacatctgcaagua

SEQ ID NO: 1527 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaagaauactgaaaaaaaacc

SEQ ID NO: 1528 - RNA, 23 nt, Artificial Sequence
  source: /note="Description of Artificial Sequence: Synthetic oligonucleotide"
uaaaagcaggucacucacuuugc

SEQ ID NO: 1529 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagcccagaagutggacgaaaa

SEQ ID NO: 1530 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaaagcacagcaatguccuga

SEQ ID NO: 1531 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccctutccucgaactgauuuuu

SEQ ID NO: 1532 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauccacagugautuggggaagu

SEQ ID NO: 1533 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgaauccaautccaagagggac

SEQ ID NO: 1534 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcggctugucacaucugcaagu

SEQ ID NO: 1535 - RNA, 23 nt, Artificial Sequence
  source: /note="Description of Artificial Sequence: Synthetic oligonucleotide"
ugcacuagagacaaagacgugau

SEQ ID NO: 1536 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucautuacacgtctgcggaucuu

SEQ ID NO: 1537 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuutccucgaactgauuuuuuu

SEQ ID NO: 1538 - RNA, 23 nt, Artificial Sequence
  source: /note="Description of Artificial Sequence: Synthetic oligonucleotide"
ucccaacucaaguccacagcagu

SEQ ID NO: 1539 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgctutcguututgccccuuuc

SEQ ID NO: 1540 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgcgagucugtgtutuugcagg

SEQ ID NO: 1541 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgcactagagacaaagacguga

SEQ ID NO: 1542 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugcgcuuucgututugccccu

SEQ ID NO: 1543 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcgcutucgututugccccuuu

SEQ ID NO: 1544 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccucgaacugaututuuuucuu

SEQ ID NO: 1545 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccutuccucgaacugauuuuuu

SEQ ID NO: 1546 - RNA, 23 nt, Artificial Sequence
  source: /note="Description of Artificial Sequence: Synthetic oligonucleotide"
ucaacgcgagucuguguuuuugc

SEQ ID NO: 1547 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccacaauuautacggauaaaca

SEQ ID NO: 1548 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutacacgucugcggaucuug

SEQ ID NO: 1549 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagacaaagacgugatguuaaua

SEQ ID NO: 1550 - RNA, 23 nt, Artificial Sequence
  source: /note="Description of Artificial Sequence: Synthetic oligonucleotide"
ucugcacuagagacaaagacgug

SEQ ID NO: 1551 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacaatuauuacggauaaacag

SEQ ID NO: 1552 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgcggaucuuguacaaacaaau

SEQ ID NO: 1553 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucccacaauuatuacggauaaac

SEQ ID NO: 1554 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugcaacgcgagtctguguuuu

SEQ ID NO: 1555 - RNA, 23 nt, Artificial Sequence
  source: /note="Description of Artificial Sequence: Synthetic oligonucleotide"
uaccaagaauacugaaaaaaaac

SEQ ID NO: 1556 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugacaaagacgtgauguuaauau

SEQ ID NO: 1557 - RNA, 21 nt, Artificial Sequence
  source: /note="Description of Artificial Sequence: Synthetic oligonucleotide"
cggaaacuuuucguccaacua

SEQ ID NO: 1558 - RNA, 21 nt, Artificial Sequence
  source: /note="Description of Artificial Sequence: Synthetic oligonucleotide"
ggaaacuuuucguccaacuua

SEQ ID NO: 1559 - RNA, 21 nt, Artificial Sequence
  source: /note="Description of Artificial Sequence: Synthetic oligonucleotide"
cgacagaacaguccuuaauca

SEQ ID NO: 1560 - RNA, 21 nt, Artificial Sequence
  source: /note="Description of Artificial Sequence: Synthetic oligonucleotide"
cugcuaauguuauugguguca

SEQ ID NO: 1561 - RNA, 21 nt, Artificial Sequence
  source: /note="Description of Artificial Sequence: Synthetic oligonucleotide"
uccgagauauuccguaguaca

SEQ ID NO: 1562 - RNA, 21 nt, Artificial Sequence
  source: /note="Description of Artificial Sequence: Synthetic oligonucleotide"
cgagauauuccguaguacaua

SEQ ID NO: 1563 - RNA, 21 nt, Artificial Sequence
  source: /note="Description of Artificial Sequence: Synthetic oligonucleotide"
gcacggaaacuuuucguccaa

SEQ ID NO: 1564 - RNA, 21 nt, Artificial Sequence
  source: /note="Description of Artificial Sequence: Synthetic oligonucleotide"
cacggaaacuuuucguccaaa

SEQ ID NO: 1565 - RNA, 21 nt, Artificial Sequence
  source: /note="Description of Artificial Sequence: Synthetic oligonucleotide"
gagauauuccguaguacauaa

SEQ ID NO: 1566 - RNA, 21 nt, Artificial Sequence
  source: /note="Description of Artificial Sequence: Synthetic oligonucleotide"
uuguuuguccaagauccgcaa

SEQ ID NO: 1567 - RNA, 21 nt, Artificial Sequence
  source: /note="Description of Artificial Sequence: Synthetic oligonucleotide"
acggaaacuuuucguccaaca

SEQ ID NO: 1568 - RNA, 21 nt, Artificial Sequence
  source: /note="Description of Artificial Sequence: Synthetic oligonucleotide"
aucaugcggaucaaaccucaa

SEQ ID NO: 1569 - RNA, 21 nt, Artificial Sequence
  source: /note="Description of Artificial Sequence: Synthetic oligonucleotide"
augcggaucaaaccucaccaa

SEQ ID NO: 1570 - RNA, 21 nt, Artificial Sequence
  source: /note="Description of Artificial Sequence: Synthetic oligonucleotide"
gaucaugcggaucaaaccuca

SEQ ID NO: 1571 - RNA, 21 nt, Artificial Sequence
  source: /note="Description of Artificial Sequence: Synthetic oligonucleotide"
uuuguuuguccaagauccgca

SEQ ID NO: 1572 - RNA, 21 nt, Artificial Sequence
  source: /note="Description of Artificial Sequence: Synthetic oligonucleotide"
gaucggugacagucacuagca

SEQ ID NO: 1573 - RNA, 21 nt, Artificial Sequence
  source: /note="Description of Artificial Sequence: Synthetic oligonucleotide"
aagauccgcagacguguaaaa

SEQ ID NO: 1574 - RNA, 21 nt, Artificial Sequence
  source: /note="Description of Artificial Sequence: Synthetic oligonucleotide"
uguccaagauccgcagacgua

SEQ ID NO: 1575 - RNA, 21 nt, Artificial Sequence
  source: /note="Description of Artificial Sequence: Synthetic oligonucleotide"
aucacgucuuugucucuagaa

SEQ ID NO: 1576 - RNA, 21 nt, Artificial Sequence
  source: /note="Description of Artificial Sequence: Synthetic oligonucleotide"
ugaaaccaugaacuuucugca

SEQ ID NO: 1577 - RNA, 21 nt, Artificial Sequence
  source: /note="Description of Artificial Sequence: Synthetic oligonucleotide"
uugucucuagagcaguuuuca

SEQ ID NO: 1578 - RNA, 21 nt, Artificial Sequence
  source: /note="Description of Artificial Sequence: Synthetic oligonucleotide"
cacuuccagaaacacgacaaa

SEQ ID NO: 1579 - RNA, 21 nt, Artificial Sequence
  source: /note="Description of Artificial Sequence: Synthetic oligonucleotide"
ugaaaucuguguuuccaauca

SEQ ID NO: 1580 - RNA, 21 nt, Artificial Sequence
  source: /note="Description of Artificial Sequence: Synthetic oligonucleotide"
gaaaucuguguuuccaaucua

SEQ ID NO: 1581 - RNA, 21 nt, Artificial Sequence
  source: /note="Description of Artificial Sequence: Synthetic oligonucleotide"
uuugucucuagagcaguuuua

SEQ ID NO: 1582 - RNA, 21 nt, Artificial Sequence
  source: /note="Description of Artificial Sequence: Synthetic oligonucleotide"
ugucucuagagcaguuuucca

SEQ ID NO: 1583 - RNA, 21 nt, Artificial Sequence
  source: /note="Description of Artificial Sequence: Synthetic oligonucleotide"
aacuguauuguuuuacgcuua

SEQ ID NO: 1584 - RNA, 21 nt, Artificial Sequence
  source: /note="Description of Artificial Sequence: Synthetic oligonucleotide"
acuguauuguuuuacgcuuua

SEQ ID NO: 1585 - RNA, 21 nt, Artificial Sequence
  source: /note="Description of Artificial Sequence: Synthetic oligonucleotide"
cuguauuguuuuacgcuuuaa

SEQ ID NO: 1586 - RNA, 21 nt, Artificial Sequence
  source: /note="Description of Artificial Sequence: Synthetic oligonucleotide"
uguauuguuuuacgcuuuaaa

SEQ ID NO: 1587 - RNA, 21 nt, Artificial Sequence
  source: /note="Description of Artificial Sequence: Synthetic oligonucleotide"
auugaaaccacuaauucugua

SEQ ID NO: 1588 - RNA, 21 nt, Artificial Sequence
  source: /note="Description of Artificial Sequence: Synthetic oligonucleotide"
acuuauuuaauagcccuuuua

SEQ ID NO: 1589 - RNA, 21 nt, Artificial Sequence
  source: /note="Description of Artificial Sequence: Synthetic oligonucleotide"
ucucuagagcaguuuuccgaa

SEQ ID NO: 1590 - RNA, 21 nt, Artificial Sequence
  source: /note="Description of Artificial Sequence: Synthetic oligonucleotide"
ccgagauauuccguaguacaa

SEQ ID NO: 1591 - RNA, 21 nt, Artificial Sequence
  source: /note="Description of Artificial Sequence: Synthetic oligonucleotide"
ucugggauuugauauucaaaa

SEQ ID NO: 1592 - RNA, 21 nt, Artificial Sequence
  source: /note="Description of Artificial Sequence: Synthetic oligonucleotide"
uucacuggauauguuugacua

SEQ ID NO: 1593 - RNA, 21 nt, Artificial Sequence
  source: /note="Description of Artificial Sequence: Synthetic oligonucleotide"
ggcucacuuccagaaacacga

SEQ ID NO: 1594 - RNA, 21 nt, Artificial Sequence
  source: /note="Description of Artificial Sequence: Synthetic oligonucleotide"
cuuccagaaacacgacaaaca

SEQ ID NO: 1595 - RNA, 21 nt, Artificial Sequence
  source: /note="Description of Artificial Sequence: Synthetic oligonucleotide"
gaccauugaaaccacuaauua

SEQ ID NO: 1596 - RNA, 21 nt, Artificial Sequence
  source: /note="Description of Artificial Sequence: Synthetic oligonucleotide"
agucacuagcuuguccugaga

SEQ ID NO: 1597 - RNA, 21 nt, Artificial Sequence
  source: /note="Description of Artificial Sequence: Synthetic oligonucleotide"
accacacauuccuuugaaaua

SEQ ID NO: 1598 - RNA, 21 nt, Artificial Sequence
  source: /note="Description of Artificial Sequence: Synthetic oligonucleotide"
accggaaagaccgauuaacca

SEQ ID NO: 1599 - RNA, 21 nt, Artificial Sequence
  source: /note="Description of Artificial Sequence: Synthetic oligonucleotide"
agaccgauuaaccaugucaca

SEQ ID NO: 1600 - RNA, 21 nt, Artificial Sequence
  source: /note="Description of Artificial Sequence: Synthetic oligonucleotide"
cuucacuggauauguuugaca

SEQ ID NO: 1601 - RNA, 21 nt, Artificial Sequence
  source: /note="Description of Artificial Sequence: Synthetic oligonucleotide"
uuggcucacuuccagaaacaa

SEQ ID NO: 1602 - RNA, 21 nt, Artificial Sequence
  source: /note="Description of Artificial Sequence: Synthetic oligonucleotide"
cucacuuccagaaacacgaca

SEQ ID NO: 1603 - RNA, 21 nt, Artificial Sequence
  source: /note="Description of Artificial Sequence: Synthetic oligonucleotide"
gugacagucacuagcuuguca

SEQ ID NO: 1604 - RNA, 21 nt, Artificial Sequence
  source: /note="Description of Artificial Sequence: Synthetic oligonucleotide"
gucucuagagcaguuuuccga

SEQ ID NO: 1605 - RNA, 21 nt, Artificial Sequence
  source: /note="Description of Artificial Sequence: Synthetic oligonucleotide"
cucuagagcaguuuuccgaga

SEQ ID NO: 1606 - RNA, 21 nt, Artificial Sequence
  source: /note="Description of Artificial Sequence: Synthetic oligonucleotide"
guuuuccgagauauuccguaa

SEQ ID NO: 1607 - RNA, 21 nt, Artificial Sequence
  source: /note="Description of Artificial Sequence: Synthetic oligonucleotide"
uuccgagauauuccguaguaa

SEQ ID NO: 1608 - RNA, 21 nt, Artificial Sequence
  source: /note="Description of Artificial Sequence: Synthetic oligonucleotide"
uuaaacuguauuguuuuacga

SEQ ID NO: 1609 - RNA, 21 nt, Artificial Sequence
  source: /note="Description of Artificial Sequence: Synthetic oligonucleotide"
aaacuguauuguuuuacgcua

SEQ ID NO: 1610 - RNA, 21 nt, Artificial Sequence
  source: /note="Description of Artificial Sequence: Synthetic oligonucleotide"
gauucgccauuuucuuauaua

SEQ ID NO: 1611 - RNA, 21 nt, Artificial Sequence
  source: /note="Description of Artificial Sequence: Synthetic oligonucleotide"
ucacuggauauguuugacuga

SEQ ID NO: 1612 - RNA, 21 nt, Artificial Sequence
  source: /note="Description of Artificial Sequence: Synthetic oligonucleotide"
guuggcucacuuccagaaaca

SEQ ID NO: 1613 - RNA, 21 nt, Artificial Sequence
  source: /note="Description of Artificial Sequence: Synthetic oligonucleotide"
acuuccagaaacacgacaaaa

SEQ ID NO: 1614 - RNA, 21 nt, Artificial Sequence
  source: /note="Description of Artificial Sequence: Synthetic oligonucleotide"
uacuuauuuaauagcccuuua

SEQ ID NO: 1615 - RNA, 21 nt, Artificial Sequence
  source: /note="Description of Artificial Sequence: Synthetic oligonucleotide"
agagcaguuuuccgagauaua

SEQ ID NO: 1616 - RNA, 21 nt, Artificial Sequence
  source: /note="Description of Artificial Sequence: Synthetic oligonucleotide"
ugggauuugauauucaaacca

SEQ ID NO: 1617 - RNA, 21 nt, Artificial Sequence
  source: /note="Description of Artificial Sequence: Synthetic oligonucleotide"
gggauuugauauucaaaccua

SEQ ID NO: 1618 - RNA, 21 nt, Artificial Sequence
  source: /note="Description of Artificial Sequence: Synthetic oligonucleotide"
gauuugauauucaaaccucua

SEQ ID NO: 1619 - RNA, 21 nt, Artificial Sequence
  source: /note="Description of Artificial Sequence: Synthetic oligonucleotide"
uaaacuguauuguuuuacgca

SEQ ID NO: 1620 - RNA, 21 nt, Artificial Sequence
  source: /note="Description of Artificial Sequence: Synthetic oligonucleotide"
ucaccggaaagaccgauuaaa

SEQ ID NO: 1621 - RNA, 21 nt, Artificial Sequence
  source: /note="Description of Artificial Sequence: Synthetic oligonucleotide"
caccggaaagaccgauuaaca

SEQ ID NO: 1622 - RNA, 21 nt, Artificial Sequence
  source: /note="Description of Artificial Sequence: Synthetic oligonucleotide"
ccggaaagaccgauuaaccaa

SEQ ID NO: 1623 - RNA, 21 nt, Artificial Sequence
  source: /note="Description of Artificial Sequence: Synthetic oligonucleotide"
gaacuggauucgccauuuuca

SEQ ID NO: 1624 - RNA, 21 nt, Artificial Sequence
  source: /note="Description of Artificial Sequence: Synthetic oligonucleotide"
cacuggauauguuugacugca

SEQ ID NO: 1625 - RNA, 21 nt, Artificial Sequence
  source: /note="Description of Artificial Sequence: Synthetic oligonucleotide"
ggaccuugugugaucagacca

SEQ ID NO: 1626 - RNA, 21 nt, Artificial Sequence
  source: /note="Description of Artificial Sequence: Synthetic oligonucleotide"
ucagaccauugaaaccacuaa

SEQ ID NO: 1627 - RNA, 21 nt, Artificial Sequence
  source: /note="Description of Artificial Sequence: Synthetic oligonucleotide"
cauugaaaccacuaauucuga

SEQ ID NO: 1628 - RNA, 21 nt, Artificial Sequence
  source: /note="Description of Artificial Sequence: Synthetic oligonucleotide"
cuagagcaguuuuccgagaua

SEQ ID NO: 1629 - RNA, 21 nt, Artificial Sequence
  source: /note="Description of Artificial Sequence: Synthetic oligonucleotide"
uagagcaguuuuccgagauaa

SEQ ID NO: 1630 - RNA, 21 nt, Artificial Sequence
  source: /note="Description of Artificial Sequence: Synthetic oligonucleotide"
aguuuuccgagauauuccgua

SEQ ID NO: 1631 - RNA, 21 nt, Artificial Sequence
  source: /note="Description of Artificial Sequence: Synthetic oligonucleotide"
gcggaucaaaccucaccaaaa

SEQ ID NO: 1632 - RNA, 21 nt, Artificial Sequence
  source: /note="Description of Artificial Sequence: Synthetic oligonucleotide"
agcauuuguuuguccaagaua

SEQ ID NO: 1633 - RNA, 21 nt, Artificial Sequence
  source: /note="Description of Artificial Sequence: Synthetic oligonucleotide"
ucucaccggaaagaccgauua

SEQ ID NO: 1634 - RNA, 21 nt, Artificial Sequence
  source: /note="Description of Artificial Sequence: Synthetic oligonucleotide"
ucuagagcaguuuuccgagaa

SEQ ID NO: 1635 - RNA, 21 nt, Artificial Sequence
  source: /note="Description of Artificial Sequence: Synthetic oligonucleotide"
auugcacggaaacuuuucgua

SEQ ID NO: 1636 - RNA, 21 nt, Artificial Sequence
  source: /note="Description of Artificial Sequence: Synthetic oligonucleotide"
gcucugggauuugauauucaa

SEQ ID NO: 1637 - RNA, 21 nt, Artificial Sequence
  source: /note="Description of Artificial Sequence: Synthetic oligonucleotide"
ugagccuuguucagagcggaa

SEQ ID NO: 1638 - RNA, 21 nt, Artificial Sequence
  source: /note="Description of Artificial Sequence: Synthetic oligonucleotide"
agccuuguucagagcggagaa

SEQ ID NO: 1639 - RNA, 21 nt, Artificial Sequence
  source: /note="Description of Artificial Sequence: Synthetic oligonucleotide"
cauuuguuuguccaagaucca

SEQ ID NO: 1640 - RNA, 21 nt, Artificial Sequence
  source: /note="Description of Artificial Sequence: Synthetic oligonucleotide"
ggaaagaccgauuaaccauga

SEQ ID NO: 1641 - RNA, 21 nt, Artificial Sequence
  source: /note="Description of Artificial Sequence: Synthetic oligonucleotide"
gaaagaccgauuaaccaugua

SEQ ID NO: 1642 - RNA, 21 nt, Artificial Sequence
  source: /note="Description of Artificial Sequence: Synthetic oligonucleotide"
aagaccgauuaaccaugucaa

SEQ ID NO: 1643 - RNA, 21 nt, Artificial Sequence
  source: /note="Description of Artificial Sequence: Synthetic oligonucleotide"
gaccgauuaaccaugucacca

SEQ ID NO: 1644 - RNA, 23 nt, Artificial Sequence
  source: /note="Description of Artificial Sequence: Synthetic oligonucleotide"
uaguuggacgaaaaguuuccgug

SEQ ID NO: 1645 - RNA, 23 nt, Artificial Sequence
  source: /note="Description of Artificial Sequence: Synthetic oligonucleotide"
uaaguuggacgaaaaguuuccgu

SEQ ID NO: 1646 - RNA, 23 nt, Artificial Sequence
  source: /note="Description of Artificial Sequence: Synthetic oligonucleotide"
ugauuaaggacuguucugucgac

SEQ ID NO: 1647 - RNA, 23 nt, Artificial Sequence
  source: /note="Description of Artificial Sequence: Synthetic oligonucleotide"
ugacaccaauaacauuagcagag

SEQ ID NO: 1648 - RNA, 23 nt, Artificial Sequence
  source: /note="Description of Artificial Sequence: Synthetic oligonucleotide"
uguacuacggaauaucucggaaa

SEQ ID NO: 1649 - RNA, 23 nt, Artificial Sequence
  source: /note="Description of Artificial Sequence: Synthetic oligonucleotide"
uauguacuacggaauaucucgga

SEQ ID NO: 1650 - RNA, 23 nt, Artificial Sequence
  source: /note="Description of Artificial Sequence: Synthetic oligonucleotide"
uuggacgaaaaguuuccgugcaa

SEQ ID NO: 1651 - RNA, 23 nt, Artificial Sequence
  source: /note="Description of Artificial Sequence: Synthetic oligonucleotide"
uuuggacgaaaaguuuccgugca

SEQ ID NO: 1652 - RNA, 23 nt, Artificial Sequence
  source: /note="Description of Artificial Sequence: Synthetic oligonucleotide"
uuauguacuacggaauaucucgg

SEQ ID NO: 1653 - RNA, 23 nt, Artificial Sequence
  source: /note="Description of Artificial Sequence: Synthetic oligonucleotide"
uugcggaucuuggacaaacaaau

SEQ ID NO: 1654 - RNA, 23 nt, Artificial Sequence
  source: /note="Description of Artificial Sequence: Synthetic oligonucleotide"
uguuggacgaaaaguuuccgugc

SEQ ID NO: 1655 - RNA, 23 nt, Artificial Sequence
  source: /note="Description of Artificial Sequence: Synthetic oligonucleotide"
uugagguuugauccgcaugaucu

SEQ ID NO: 1656 - RNA, 23 nt, Artificial Sequence
  source: /note="Description of Artificial Sequence: Synthetic oligonucleotide"
uuggugagguuugauccgcauga

SEQ ID NO: 1657 - RNA, 23 nt, Artificial Sequence
  source: /note="Description of Artificial Sequence: Synthetic oligonucleotide"
ugagguuugauccgcaugaucug

SEQ ID NO: 1658 - RNA, 23 nt, Artificial Sequence
  source: /note="Description of Artificial Sequence: Synthetic oligonucleotide"
ugcggaucuuggacaaacaaaug

SEQ ID NO: 1659 - RNA, 23 nt, Artificial Sequence
  source: /note="Description of Artificial Sequence: Synthetic oligonucleotide"
ugcuagugacugucaccgaucug

SEQ ID NO: 1660 - RNA, 23 nt, Artificial Sequence
  source: /note="Description of Artificial Sequence: Synthetic oligonucleotide"
uuuuacacgucugcggaucuugg

SEQ ID NO: 1661 - RNA, 23 nt, Artificial Sequence
  source: /note="Description of Artificial Sequence: Synthetic oligonucleotide"
uacgucugcggaucuuggacaaa

SEQ ID NO: 1662 - RNA, 23 nt, Artificial Sequence
  source: /note="Description of Artificial Sequence: Synthetic oligonucleotide"
uucuagagacaaagacgugaugu

SEQ ID NO: 1663 - RNA, 23 nt, Artificial Sequence
  source: /note="Description of Artificial Sequence: Synthetic oligonucleotide"
ugcagaaaguucaugguuucaga

SEQ ID NO: 1664 - RNA, 23 nt, Artificial Sequence
  source: /note="Description of Artificial Sequence: Synthetic oligonucleotide"
ugaaaacugcucuagagacaaag

SEQ ID NO: 1665 - RNA, 23 nt, Artificial Sequence
  source: /note="Description of Artificial Sequence: Synthetic oligonucleotide"
uuugucguguuucuggaagugag

SEQ ID NO: 1666 - RNA, 23 nt, Artificial Sequence
  source: /note="Description of Artificial Sequence: Synthetic oligonucleotide"
ugauuggaaacacagauuucaua

SEQ ID NO: 1667 - RNA, 23 nt, Artificial Sequence
  source: /note="Description of Artificial Sequence: Synthetic oligonucleotide"
uagauuggaaacacagauuucau

SEQ ID NO: 1668 - RNA, 23 nt, Artificial Sequence
  source: /note="Description of Artificial Sequence: Synthetic oligonucleotide"
uaaaacugcucuagagacaaaga

SEQ ID NO: 1669 - RNA, 23 nt, Artificial Sequence
  source: /note="Description of Artificial Sequence: Synthetic oligonucleotide"
uggaaaacugcucuagagacaaa

SEQ ID NO: 1670 - RNA, 23 nt, Artificial Sequence
  source: /note="Description of Artificial Sequence: Synthetic oligonucleotide"
uaagcguaaaacaauacaguuua

SEQ ID NO: 1671 - RNA, 23 nt, Artificial Sequence
  source: /note="Description of Artificial Sequence: Synthetic oligonucleotide"
uaaagcguaaaacaauacaguuu

SEQ ID NO: 1672 - RNA, 23 nt, Artificial Sequence
  source: /note="Description of Artificial Sequence: Synthetic oligonucleotide"
uuaaagcguaaaacaauacaguu

SEQ ID NO: 1673 - RNA, 23 nt, Artificial Sequence
  source: /note="Description of Artificial Sequence: Synthetic oligonucleotide"
uuuaaagcguaaaacaauacagu

SEQ ID NO: 1674 - RNA, 23 nt, Artificial Sequence
  source: /note="Description of Artificial Sequence: Synthetic oligonucleotide"
uacagaauuagugguuucaaugg

SEQ ID NO: 1675 - RNA, 23 nt, Artificial Sequence
  source: /note="Description of Artificial Sequence: Synthetic oligonucleotide"
uaaaagggcuauuaaauaaguac

SEQ ID NO: 1676 - RNA, 23 nt, Artificial Sequence
  source: /note="Description of Artificial Sequence: Synthetic oligonucleotide"
uucggaaaacugcucuagagaca

SEQ ID NO: 1677 - RNA, 23 nt, Artificial Sequence
  source: /note="Description of Artificial Sequence: Synthetic oligonucleotide"
uuguacuacggaauaucucggaa

SEQ ID NO: 1678 - RNA, 23 nt, Artificial Sequence
  source: /note="Description of Artificial Sequence: Synthetic oligonucleotide"
uuuugaauaucaaaucccagagc

SEQ ID NO: 1679 - RNA, 23 nt, Artificial Sequence
  source: /note="Description of Artificial Sequence: Synthetic oligonucleotide"
uagucaaacauauccagugaaga

SEQ ID NO: 1680 - RNA, 23 nt, Artificial Sequence
  source: /note="Description of Artificial Sequence: Synthetic oligonucleotide"
ucguguuucuggaagugagccaa

SEQ ID NO: 1681 - RNA, 23 nt, Artificial Sequence
  source: /note="Description of Artificial Sequence: Synthetic oligonucleotide"
uguuugucguguuucuggaagug

SEQ ID NO: 1682 - RNA, 23 nt, Artificial Sequence
  source: /note="Description of Artificial Sequence: Synthetic oligonucleotide"
uaauuagugguuucaauggucug

SEQ ID NO: 1683 - RNA, 23 nt, Artificial Sequence
  source: /note="Description of Artificial Sequence: Synthetic oligonucleotide"
ucucaggacaagcuagugacugu

SEQ ID NO: 1684 - RNA, 23 nt, Artificial Sequence
  source: /note="Description of Artificial Sequence: Synthetic oligonucleotide"
uauuucaaaggaauguguggugg

SEQ ID NO: 1685 - RNA, 23 nt, Artificial Sequence
  source: /note="Description of Artificial Sequence: Synthetic oligonucleotide"
ugguuaaucggucuuuccgguga

SEQ ID NO: 1686 - RNA, 23 nt, Artificial Sequence
  source: /note="Description of Artificial Sequence: Synthetic oligonucleotide"
ugugacaugguuaaucggucuuu

SEQ ID NO: 1687 - RNA, 23 nt, Artificial Sequence
  source: /note="Description of Artificial Sequence: Synthetic oligonucleotide"
ugucaaacauauccagugaagac

SEQ ID NO: 1688 - RNA, 23 nt, Artificial Sequence
  source: /note="Description of Artificial Sequence: Synthetic oligonucleotide"
uuguuucuggaagugagccaacg

SEQ ID NO: 1689 - RNA, 23 nt, Artificial Sequence
  source: /note="Description of Artificial Sequence: Synthetic oligonucleotide"
ugucguguuucuggaagugagcc

SEQ ID NO: 1690 - RNA, 23 nt, Artificial Sequence
  source: /note="Description of Artificial Sequence: Synthetic oligonucleotide"
ugacaagcuagugacugucaccg

SEQ ID NO: 1691 - RNA, 23 nt, Artificial Sequence
  source: /note="Description of Artificial Sequence: Synthetic oligonucleotide"
ucggaaaacugcucuagagacaa

SEQ ID NO: 1692 - RNA, 23 nt, Artificial Sequence
  source: /note="Description of Artificial Sequence: Synthetic oligonucleotide"
ucucggaaaacugcucuagagac

SEQ ID NO: 1693 - RNA, 23 nt, Artificial Sequence
  source: /note="Description of Artificial Sequence: Synthetic oligonucleotide"
uuacggaauaucucggaaaacug

SEQ ID NO: 1694 - RNA, 23 nt, Artificial Sequence
  source: /note="Description of Artificial Sequence: Synthetic oligonucleotide"
uuacuacggaauaucucggaaaa

SEQ ID NO: 1695 - RNA, 23 nt, Artificial Sequence
  source: /note="Description of Artificial Sequence: Synthetic oligonucleotide"
ucguaaaacaauacaguuuaaga

SEQ ID NO: 1696 - RNA, 23 nt, Artificial Sequence
  source: /note="Description of Artificial Sequence: Synthetic oligonucleotide"
uagcguaaaacaauacaguuuaa

SEQ ID NO: 1697 - RNA, 23 nt, Artificial Sequence
  source: /note="Description of Artificial Sequence: Synthetic oligonucleotide"
uauauaagaaaauggcgaaucca

SEQ ID NO: 1698 - RNA, 23 nt, Artificial Sequence
  source: /note="Description of Artificial Sequence: Synthetic oligonucleotide"
ucagucaaacauauccagugaag

SEQ ID NO: 1699 - RNA, 23 nt, Artificial Sequence
  source: /note="Description of Artificial Sequence: Synthetic oligonucleotide"
uguuucuggaagugagccaacgu

SEQ ID NO: 1700 - RNA, 23 nt, Artificial Sequence
  source: /note="Description of Artificial Sequence: Synthetic oligonucleotide"
uuuugucguguuucuggaaguga

SEQ ID NO: 1701 - RNA, 23 nt, Artificial Sequence
  source: /note="Description of Artificial Sequence: Synthetic oligonucleotide"
uaaagggcuauuaaauaaguacc

SEQ ID NO: 1702 - RNA, 23 nt, Artificial Sequence
  source: /note="Description of Artificial Sequence: Synthetic oligonucleotide"
uauaucucggaaaacugcucuag

SEQ ID NO: 1703 - RNA, 23 nt, Artificial Sequence
  source: /note="Description of Artificial Sequence: Synthetic oligonucleotide"
ugguuugaauaucaaaucccaga

SEQ ID NO: 1704 - RNA, 23 nt, Artificial Sequence
  source: /note="Description of Artificial Sequence: Synthetic oligonucleotide"
uagguuugaauaucaaaucccag

SEQ ID NO: 1705 - RNA, 23 nt, Artificial Sequence
  source: /note="Description of Artificial Sequence: Synthetic oligonucleotide"
uagagguuugaauaucaaauccc

SEQ ID NO: 1706 - RNA, 23 nt, Artificial Sequence
  source: /note="Description of Artificial Sequence: Synthetic oligonucleotide"
ugcguaaaacaauacaguuuaag

SEQ ID NO: 1707 - RNA, 23 nt, Artificial Sequence
  source: /note="Description of Artificial Sequence: Synthetic oligonucleotide"
uuuaaucggucuuuccggugaga

SEQ ID NO: 1708 - RNA, 23 nt, Artificial Sequence
  source: /note="Description of Artificial Sequence: Synthetic oligonucleotide"
uguuaaucggucuuuccggugag

SEQ ID NO: 1709 - RNA, 23 nt, Artificial Sequence
  source: /note="Description of Artificial Sequence: Synthetic oligonucleotide"
uugguuaaucggucuuuccggug

SEQ ID NO: 1710 - RNA, 23 nt, Artificial Sequence
  source: /note="Description of Artificial Sequence: Synthetic oligonucleotide"
ugaaaauggcgaauccaguucca

SEQ ID NO: 1711 - RNA, 23 nt, Artificial Sequence
  source: /note="Description of Artificial Sequence: Synthetic oligonucleotide"
ugcagucaaacauauccagugaa

SEQ ID NO: 1712 - RNA, 23 nt, Artificial Sequence
  source: /note="Description of Artificial Sequence: Synthetic oligonucleotide"
uggucugaucacacaagguccuc

SEQ ID NO: 1713 - RNA, 23 nt, Artificial Sequence
  source: /note="Description of Artificial Sequence: Synthetic oligonucleotide"
uuagugguuucaauggucugauc

SEQ ID NO: 1714 - RNA, 23 nt, Artificial Sequence
  source: /note="Description of Artificial Sequence: Synthetic oligonucleotide"
ucagaauuagugguuucaauggu

SEQ ID NO: 1715 - RNA, 23 nt, Artificial Sequence
  source: /note="Description of Artificial Sequence: Synthetic oligonucleotide"
uaucucggaaaacugcucuagag

SEQ ID NO: 1716 - RNA, 23 nt, Artificial Sequence
  source: /note="Description of Artificial Sequence: Synthetic oligonucleotide"
uuaucucggaaaacugcucuaga

SEQ ID NO: 1717 - RNA, 23 nt, Artificial Sequence
  source: /note="Description of Artificial Sequence: Synthetic oligonucleotide"
uacggaauaucucggaaaacugc

SEQ ID NO: 1718 - RNA, 23 nt, Artificial Sequence
  source: /note="Description of Artificial Sequence: Synthetic oligonucleotide"
uuuuggugagguuugauccgcau

SEQ ID NO: 1719 - RNA, 23 nt, Artificial Sequence
  source: /note="Description of Artificial Sequence: Synthetic oligonucleotide"
uaucuuggacaaacaaaugcuuu

SEQ ID NO: 1720 - RNA, 23 nt, Artificial Sequence
  source: /note="Description of Artificial Sequence: Synthetic oligonucleotide"
uaaucggucuuuccggugagagg

SEQ ID NO: 1721 - RNA, 23 nt, Artificial Sequence
  source: /note="Description of Artificial Sequence: Synthetic oligonucleotide"
uucucggaaaacugcucuagaga

SEQ ID NO: 1722 - RNA, 23 nt, Artificial Sequence
  source: /note="Description of Artificial Sequence: Synthetic oligonucleotide"
uacgaaaaguuuccgugcaaucc

SEQ ID NO: 1723 - RNA, 23 nt, Artificial Sequence
  source: /note="Description of Artificial Sequence: Synthetic oligonucleotide"
uugaauaucaaaucccagagcac

SEQ ID NO: 1724 - RNA, 23 nt, Artificial Sequence
  source: /note="Description of Artificial Sequence: Synthetic oligonucleotide"
uuccgcucugaacaaggcucaca

SEQ ID NO: 1725 - RNA, 23 nt, Artificial Sequence
  source: /note="Description of Artificial Sequence: Synthetic oligonucleotide"
uucuccgcucugaacaaggcuca

SEQ ID NO: 1726 - RNA, 23 nt, Artificial Sequence
  source: /note="Description of Artificial Sequence: Synthetic oligonucleotide"
uggaucuuggacaaacaaaugcu

SEQ ID NO: 1727 - RNA, 23 nt, Artificial Sequence
  source: /note="Description of Artificial Sequence: Synthetic oligonucleotide"
ucaugguuaaucggucuuuccgg

SEQ ID NO: 1728 - RNA, 23 nt, Artificial Sequence
  source: /note="Description of Artificial Sequence: Synthetic oligonucleotide"
uacaugguuaaucggucuuuccg

SEQ ID NO: 1729 - RNA, 23 nt, Artificial Sequence
  source: /note="Description of Artificial Sequence: Synthetic oligonucleotide"
uugacaugguuaaucggucuuuc

SEQ ID NO: 1730 - RNA, 23 nt, Artificial Sequence
  source: /note="Description of Artificial Sequence: Synthetic oligonucleotide"
uggugacaugguuaaucggucuu

SEQ ID NO: 1731 - RNA, 21 nt, Artificial Sequence
  source: /note="Description of Artificial Sequence: Synthetic oligonucleotide"
cggaaacuuuucguccaacua

SEQ ID NO: 1732 - RNA, 21 nt, Artificial Sequence
  source: /note="Description of Artificial Sequence: Synthetic oligonucleotide"
ggaaacuuuucguccaacuua

SEQ ID NO: 1733 - RNA, 21 nt, Artificial Sequence
  source: /note="Description of Artificial Sequence: Synthetic oligonucleotide"
cgacagaacaguccuuaauca

SEQ ID NO: 1734 - RNA, 21 nt, Artificial Sequence
  source: /note="Description of Artificial Sequence: Synthetic oligonucleotide"
cugcuaauguuauugguguca

SEQ ID NO: 1735 - RNA, 21 nt, Artificial Sequence
  source: /note="Description of Artificial Sequence: Synthetic oligonucleotide"
uccgagauauuccguaguaca

SEQ ID NO: 1736 - RNA, 21 nt, Artificial Sequence
  source: /note="Description of Artificial Sequence: Synthetic oligonucleotide"
cgagauauuccguaguacaua

SEQ ID NO: 1737 - RNA, 21 nt, Artificial Sequence
  source: /note="Description of Artificial Sequence: Synthetic oligonucleotide"
gcacggaaacuuuucguccaa

SEQ ID NO: 1738 - RNA, 21 nt, Artificial Sequence
  source: /note="Description of Artificial Sequence: Synthetic oligonucleotide"
cacggaaacuuuucguccaaa

SEQ ID NO: 1739 - RNA, 21 nt, Artificial Sequence
  source: /note="Description of Artificial Sequence: Synthetic oligonucleotide"
gagauauuccguaguacauaa

SEQ ID NO: 1740 - RNA, 21 nt, Artificial Sequence
  source: /note="Description of Artificial Sequence: Synthetic oligonucleotide"
uuguuuguccaagauccgcaa

SEQ ID NO: 1741 - RNA, 21 nt, Artificial Sequence
  source: /note="Description of Artificial Sequence: Synthetic oligonucleotide"
acggaaacuuuucguccaaca

SEQ ID NO: 1742 - RNA, 21 nt, Artificial Sequence
  source: /note="Description of Artificial Sequence: Synthetic oligonucleotide"
aucaugcggaucaaaccucaa

SEQ ID NO: 1743 - RNA, 21 nt, Artificial Sequence
  source: /note="Description of Artificial Sequence: Synthetic oligonucleotide"
augcggaucaaaccucaccaa

SEQ ID NO: 1744 - RNA, 21 nt, Artificial Sequence
  source: /note="Description of Artificial Sequence: Synthetic oligonucleotide"
gaucaugcggaucaaaccuca

SEQ ID NO: 1745 - RNA, 21 nt, Artificial Sequence
  source: /note="Description of Artificial Sequence: Synthetic oligonucleotide"
uuuguuuguccaagauccgca

SEQ ID NO: 1746 - RNA, 21 nt, Artificial Sequence
  source: /note="Description of Artificial Sequence: Synthetic oligonucleotide"
gaucggugacagucacuagca

SEQ ID NO: 1747 - RNA, 21 nt, Artificial Sequence
  source: /note="Description of Artificial Sequence: Synthetic oligonucleotide"
aagauccgcagacguguaaaa

SEQ ID NO: 1748 - RNA, 21 nt, Artificial Sequence
  source: /note="Description of Artificial Sequence: Synthetic oligonucleotide"
uguccaagauccgcagacgua

SEQ ID NO: 1749 - RNA, 21 nt, Artificial Sequence
  source: /note="Description of Artificial Sequence: Synthetic oligonucleotide"
aucacgucuuugucucuagaa

SEQ ID NO: 1750 - RNA, 21 nt, Artificial Sequence
  source: /note="Description of Artificial Sequence: Synthetic oligonucleotide"
ugaaaccaugaacuuucugca

SEQ ID NO: 1751 - RNA, 21 nt, Artificial Sequence
  source: /note="Description of Artificial Sequence: Synthetic oligonucleotide"
uugucucuagagcaguuuuca

SEQ ID NO: 1752 - RNA, 21 nt, Artificial Sequence
  source: /note="Description of Artificial Sequence: Synthetic oligonucleotide"
cacuuccagaaacacgacaaa

SEQ ID NO: 1753 - RNA, 21 nt, Artificial Sequence
  source: /note="Description of Artificial Sequence: Synthetic oligonucleotide"
ugaaaucuguguuuccaauca

SEQ ID NO: 1754 - RNA, 21 nt, Artificial Sequence
  source: /note="Description of Artificial Sequence: Synthetic oligonucleotide"
gaaaucuguguuuccaaucua

SEQ ID NO: 1755 - RNA, 21 nt, Artificial Sequence
  source: /note="Description of Artificial Sequence: Synthetic oligonucleotide"
uuugucucuagagcaguuuua

SEQ ID NO: 1756 - RNA, 21 nt, Artificial Sequence
  source: /note="Description of Artificial Sequence: Synthetic oligonucleotide"
ugucucuagagcaguuuucca

SEQ ID NO: 1757 - RNA, 21 nt, Artificial Sequence
  source: /note="Description of Artificial Sequence: Synthetic oligonucleotide"
aacuguauuguuuuacgcuua

SEQ ID NO: 1758 - RNA, 21 nt, Artificial Sequence
  source: /note="Description of Artificial Sequence: Synthetic oligonucleotide"
acuguauuguuuuacgcuuua

SEQ ID NO: 1759 - RNA, 21 nt, Artificial Sequence
  source: /note="Description of Artificial Sequence: Synthetic oligonucleotide"
cuguauuguuuuacgcuuuaa

SEQ ID NO: 1760 - RNA, 21 nt, Artificial Sequence
  source: /note="Description of Artificial Sequence: Synthetic oligonucleotide"
uguauuguuuuacgcuuuaaa

SEQ ID NO: 1761 - RNA, 21 nt, Artificial Sequence
  source: /note="Description of Artificial Sequence: Synthetic oligonucleotide"
auugaaaccacuaauucugua

SEQ ID NO: 1762 - RNA, 21 nt, Artificial Sequence
  source: /note="Description of Artificial Sequence: Synthetic oligonucleotide"
acuuauuuaauagcccuuuua

SEQ ID NO: 1763 - RNA, 21 nt, Artificial Sequence
  source: /note="Description of Artificial Sequence: Synthetic oligonucleotide"
ucucuagagcaguuuuccgaa

SEQ ID NO: 1764 - RNA, 21 nt, Artificial Sequence
  source: /note="Description of Artificial Sequence: Synthetic oligonucleotide"
ccgagauauuccguaguacaa

SEQ ID NO: 1765 - RNA, 21 nt, Artificial Sequence
  source: /note="Description of Artificial Sequence: Synthetic oligonucleotide"
ucugggauuugauauucaaaa

SEQ ID NO: 1766 - RNA, 21 nt, Artificial Sequence
  source: /note="Description of Artificial Sequence: Synthetic oligonucleotide"
uucacuggauauguuugacua

SEQ ID NO: 1767 - RNA, 21 nt, Artificial Sequence
  source: /note="Description of Artificial Sequence: Synthetic oligonucleotide"
ggcucacuuccagaaacacga

SEQ ID NO: 1768 - RNA, 21 nt, Artificial Sequence
  source: /note="Description of Artificial Sequence: Synthetic oligonucleotide"
cuuccagaaacacgacaaaca

SEQ ID NO: 1769 - RNA, 21 nt, Artificial Sequence
  source: /note="Description of Artificial Sequence: Synthetic oligonucleotide"
gaccauugaaaccacuaauua

SEQ ID NO: 1770 - RNA, 21 nt, Artificial Sequence
  source: /note="Description of Artificial Sequence: Synthetic oligonucleotide"
agucacuagcuuguccugaga

SEQ ID NO: 1771 - RNA, 21 nt, Artificial Sequence
  source: /note="Description of Artificial Sequence: Synthetic oligonucleotide"
accacacauuccuuugaaaua

SEQ ID NO: 1772 - RNA, 21 nt, Artificial Sequence
  source: /note="Description of Artificial Sequence: Synthetic oligonucleotide"
accggaaagaccgauuaacca

SEQ ID NO: 1773 - RNA, 21 nt, Artificial Sequence
  source: /note="Description of Artificial Sequence: Synthetic oligonucleotide"
agaccgauuaaccaugucaca

SEQ ID NO: 1774 - RNA, 21 nt, Artificial Sequence
  source: /note="Description of Artificial Sequence: Synthetic oligonucleotide"
cuucacuggauauguuugaca

SEQ ID NO: 1775 - RNA, 21 nt, Artificial Sequence
  source: /note="Description of Artificial Sequence: Synthetic oligonucleotide"
uuggcucacuuccagaaacaa

SEQ ID NO: 1776 - RNA, 21 nt, Artificial Sequence
  source: /note="Description of Artificial Sequence: Synthetic oligonucleotide"
cucacuuccagaaacacgaca

SEQ ID NO: 1777 - RNA, 21 nt, Artificial Sequence
  source: /note="Description of Artificial Sequence: Synthetic oligonucleotide"
gugacagucacuagcuuguca

SEQ ID NO: 1778 - RNA, 21 nt, Artificial Sequence
  source: /note="Description of Artificial Sequence: Synthetic oligonucleotide"
gucucuagagcaguuuuccga

SEQ ID NO: 1779 - RNA, 21 nt, Artificial Sequence
  source: /note="Description of Artificial Sequence: Synthetic oligonucleotide"
cucuagagcaguuuuccgaga

SEQ ID NO: 1780 - RNA, 21 nt, Artificial Sequence
  source: /note="Description of Artificial Sequence: Synthetic oligonucleotide"
guuuuccgagauauuccguaa

SEQ ID NO: 1781 - RNA, 21 nt, Artificial Sequence
  source: /note="Description of Artificial Sequence: Synthetic oligonucleotide"
uuccgagauauuccguaguaa

SEQ ID NO: 1782 - RNA, 21 nt, Artificial Sequence
  source: /note="Description of Artificial Sequence: Synthetic oligonucleotide"
uuaaacuguauuguuuuacga

SEQ ID NO: 1783 - RNA, 21 nt, Artificial Sequence
  source: /note="Description of Artificial Sequence: Synthetic oligonucleotide"
aaacuguauuguuuuacgcua

SEQ ID NO: 1784 - RNA, 21 nt, Artificial Sequence
  source: /note="Description of Artificial Sequence: Synthetic oligonucleotide"
gauucgccauuuucuuauaua

SEQ ID NO: 1785 - RNA, 21 nt, Artificial Sequence
  source: /note="Description of Artificial Sequence: Synthetic oligonucleotide"
ucacuggauauguuugacuga

SEQ ID NO: 1786 - RNA, 21 nt, Artificial Sequence
  source: /note="Description of Artificial Sequence: Synthetic oligonucleotide"
guuggcucacuuccagaaaca

SEQ ID NO: 1787 - RNA, 21 nt, Artificial Sequence
  source: /note="Description of Artificial Sequence: Synthetic oligonucleotide"
acuuccagaaacacgacaaaa

SEQ ID NO: 1788 - RNA, 21 nt, Artificial Sequence
  source: /note="Description of Artificial Sequence: Synthetic oligonucleotide"
uacuuauuuaauagcccuuua

SEQ ID NO: 1789 - RNA, 21 nt, Artificial Sequence
  source: /note="Description of Artificial Sequence: Synthetic oligonucleotide"
agagcaguuuuccgagauaua

SEQ ID NO: 1790 - RNA, 21 nt, Artificial Sequence
  source: /note="Description of Artificial Sequence: Synthetic oligonucleotide"
ugggauuugauauucaaacca

SEQ ID NO: 1791 - RNA, 21 nt, Artificial Sequence
  source: /note="Description of Artificial Sequence: Synthetic oligonucleotide"
gggauuugauauucaaaccua

SEQ ID NO: 1792 - RNA, 21 nt, Artificial Sequence
  source: /note="Description of Artificial Sequence: Synthetic oligonucleotide"
gauuugauauucaaaccucua

SEQ ID NO: 1793 - RNA, 21 nt, Artificial Sequence
  source: /note="Description of Artificial Sequence: Synthetic oligonucleotide"
uaaacuguauuguuuuacgca

SEQ ID NO: 1794 - RNA, 21 nt, Artificial Sequence
  source: /note="Description of Artificial Sequence: Synthetic oligonucleotide"
ucaccggaaagaccgauuaaa

SEQ ID NO: 1795 - RNA, 21 nt, Artificial Sequence
  source: /note="Description of Artificial Sequence: Synthetic oligonucleotide"
caccggaaagaccgauuaaca

SEQ ID NO: 1796 - RNA, 21 nt, Artificial Sequence
  source: /note="Description of Artificial Sequence: Synthetic oligonucleotide"
ccggaaagaccgauuaaccaa

SEQ ID NO: 1797 - RNA, 21 nt, Artificial Sequence
  source: /note="Description of Artificial Sequence: Synthetic oligonucleotide"
gaacuggauucgccauuuuca

SEQ ID NO: 1798 - RNA, 21 nt, Artificial Sequence
  source: /note="Description of Artificial Sequence: Synthetic oligonucleotide"
cacuggauauguuugacugca

SEQ ID NO: 1799 - RNA, 21 nt, Artificial Sequence
  source: /note="Description of Artificial Sequence: Synthetic oligonucleotide"
ggaccuugugugaucagacca

SEQ ID NO: 1800 - RNA, 21 nt, Artificial Sequence
  source: /note="Description of Artificial Sequence: Synthetic oligonucleotide"
ucagaccauugaaaccacuaa

SEQ ID NO: 1801 - RNA, 21 nt, Artificial Sequence
  source: /note="Description of Artificial Sequence: Synthetic oligonucleotide"
cauugaaaccacuaauucuga

SEQ ID NO: 1802 - RNA, 21 nt, Artificial Sequence
  source: /note="Description of Artificial Sequence: Synthetic oligonucleotide"
cuagagcaguuuuccgagaua

SEQ ID NO: 1803 - RNA, 21 nt, Artificial Sequence
  source: /note="Description of Artificial Sequence: Synthetic oligonucleotide"
uagagcaguuuuccgagauaa

SEQ ID NO: 1804 - RNA, 21 nt, Artificial Sequence
  source: /note="Description of Artificial Sequence: Synthetic oligonucleotide"
aguuuuccgagauauuccgua

SEQ ID NO: 1805 - RNA, 21 nt, Artificial Sequence
  source: /note="Description of Artificial Sequence: Synthetic oligonucleotide"
gcggaucaaaccucaccaaaa

SEQ ID NO: 1806 - RNA, 21 nt, Artificial Sequence
  source: /note="Description of Artificial Sequence: Synthetic oligonucleotide"
agcauuuguuuguccaagaua

SEQ ID NO: 1807 - RNA, 21 nt, Artificial Sequence
  source: /note="Description of Artificial Sequence: Synthetic oligonucleotide"
ucucaccggaaagaccgauua

SEQ ID NO: 1808 - RNA, 21 nt, Artificial Sequence
  source: /note="Description of Artificial Sequence: Synthetic oligonucleotide"
ucuagagcaguuuuccgagaa

SEQ ID NO: 1809 - RNA, 21 nt, Artificial Sequence
  source: /note="Description of Artificial Sequence: Synthetic oligonucleotide"
auugcacggaaacuuuucgua

SEQ ID NO: 1810 - RNA, 21 nt, Artificial Sequence
  source: /note="Description of Artificial Sequence: Synthetic oligonucleotide"
gcucugggauuugauauucaa

SEQ ID NO: 1811 - RNA, 21 nt, Artificial Sequence
  source: /note="Description of Artificial Sequence: Synthetic oligonucleotide"
ugagccuuguucagagcggaa

SEQ ID NO: 1812 - RNA, 21 nt, Artificial Sequence
  source: /note="Description of Artificial Sequence: Synthetic oligonucleotide"
agccuuguucagagcggagaa

SEQ ID NO: 1813 - RNA, 21 nt, Artificial Sequence
  source: /note="Description of Artificial Sequence: Synthetic oligonucleotide"
cauuuguuuguccaagaucca

SEQ ID NO: 1814 - RNA, 21 nt, Artificial Sequence
  source: /note="Description of Artificial Sequence: Synthetic oligonucleotide"
ggaaagaccgauuaaccauga

SEQ ID NO: 1815 - RNA, 21 nt, Artificial Sequence
  source: /note="Description of Artificial Sequence: Synthetic oligonucleotide"
gaaagaccgauuaaccaugua

SEQ ID NO: 1816 - RNA, 21 nt, Artificial Sequence
  source: /note="Description of Artificial Sequence: Synthetic oligonucleotide"
aagaccgauuaaccaugucaa

SEQ ID NO: 1817 - RNA, 21 nt, Artificial Sequence
  source: /note="Description of Artificial Sequence: Synthetic oligonucleotide"
gaccgauuaaccaugucacca

SEQ ID NO: 1818 - RNA, 23 nt, Artificial Sequence
  source: /note="Description of Artificial Sequence: Synthetic oligonucleotide"
uaguuggacgaaaaguuuccgug

SEQ ID NO: 1819 - RNA, 23 nt, Artificial Sequence
  source: /note="Description of Artificial Sequence: Synthetic oligonucleotide"
uaaguuggacgaaaaguuuccgu

SEQ ID NO: 1820 - RNA, 23 nt, Artificial Sequence
  source: /note="Description of Artificial Sequence: Synthetic oligonucleotide"
ugauuaaggacuguucugucgac

SEQ ID NO: 1821 - RNA, 23 nt, Artificial Sequence
  source: /note="Description of Artificial Sequence: Synthetic oligonucleotide"
ugacaccaauaacauuagcagag

SEQ ID NO: 1822 - RNA, 23 nt, Artificial Sequence
  source: /note="Description of Artificial Sequence: Synthetic oligonucleotide"
uguacuacggaauaucucggaaa

SEQ ID NO: 1823 - RNA, 23 nt, Artificial Sequence
  source: /note="Description of Artificial Sequence: Synthetic oligonucleotide"
uauguacuacggaauaucucgga

SEQ ID NO: 1824 - RNA, 23 nt, Artificial Sequence
  source: /note="Description of Artificial Sequence: Synthetic oligonucleotide"
uuggacgaaaaguuuccgugcaa

SEQ ID NO: 1825 - RNA, 23 nt, Artificial Sequence
  source: /note="Description of Artificial Sequence: Synthetic oligonucleotide"
uuuggacgaaaaguuuccgugca

SEQ ID NO: 1826 - RNA, 23 nt, Artificial Sequence
  source: /note="Description of Artificial Sequence: Synthetic oligonucleotide"
uuauguacuacggaauaucucgg

SEQ ID NO: 1827 - RNA, 23 nt, Artificial Sequence
  source: /note="Description of Artificial Sequence: Synthetic oligonucleotide"
uugcggaucuuggacaaacaaau

SEQ ID NO: 1828 - RNA, 23 nt, Artificial Sequence
  source: /note="Description of Artificial Sequence: Synthetic oligonucleotide"
uguuggacgaaaaguuuccgugc

SEQ ID NO: 1829 - RNA, 23 nt, Artificial Sequence
  source: /note="Description of Artificial Sequence: Synthetic oligonucleotide"
uugagguuugauccgcaugaucu

SEQ ID NO: 1830 - RNA, 23 nt, Artificial Sequence
  source: /note="Description of Artificial Sequence: Synthetic oligonucleotide"
uuggugagguuugauccgcauga

SEQ ID NO: 1831 - RNA, 23 nt, Artificial Sequence
  source: /note="Description of Artificial Sequence: Synthetic oligonucleotide"
ugagguuugauccgcaugaucug

SEQ ID NO: 1832 - RNA, 23 nt, Artificial Sequence
  source: /note="Description of Artificial Sequence: Synthetic oligonucleotide"
ugcggaucuuggacaaacaaaug

SEQ ID NO: 1833 - RNA, 23 nt, Artificial Sequence
  source: /note="Description of Artificial Sequence: Synthetic oligonucleotide"
ugcuagugacugucaccgaucug

SEQ ID NO: 1834 - RNA, 23 nt, Artificial Sequence
  source: /note="Description of Artificial Sequence: Synthetic oligonucleotide"
uuuuacacgucugcggaucuugg

SEQ ID NO: 1835 - RNA, 23 nt, Artificial Sequence
  source: /note="Description of Artificial Sequence: Synthetic oligonucleotide"
uacgucugcggaucuuggacaaa

SEQ ID NO: 1836 - RNA, 23 nt, Artificial Sequence
  source: /note="Description of Artificial Sequence: Synthetic oligonucleotide"
uucuagagacaaagacgugaugu

SEQ ID NO: 1837 - RNA, 23 nt, Artificial Sequence
  source: /note="Description of Artificial Sequence: Synthetic oligonucleotide"
ugcagaaaguucaugguuucaga

SEQ ID NO: 1838 - RNA, 23 nt, Artificial Sequence
  source: /note="Description of Artificial Sequence: Synthetic oligonucleotide"
ugaaaacugcucuagagacaaag

SEQ ID NO: 1839 - RNA, 23 nt, Artificial Sequence
  source: /note="Description of Artificial Sequence: Synthetic oligonucleotide"
uuugucguguuucuggaagugag

SEQ ID NO: 1840 - RNA, 23 nt, Artificial Sequence
  source: /note="Description of Artificial Sequence: Synthetic oligonucleotide"
ugauuggaaacacagauuucaua

SEQ ID NO: 1841 - RNA, 23 nt, Artificial Sequence
  source: /note="Description of Artificial Sequence: Synthetic oligonucleotide"
uagauuggaaacacagauuucau

SEQ ID NO: 1842 - RNA, 23 nt, Artificial Sequence
  source: /note="Description of Artificial Sequence: Synthetic oligonucleotide"
uaaaacugcucuagagacaaaga

SEQ ID NO: 1843 - RNA, 23 nt, Artificial Sequence
  source: /note="Description of Artificial Sequence: Synthetic oligonucleotide"
uggaaaacugcucuagagacaaa

SEQ ID NO: 1844 - RNA, 23 nt, Artificial Sequence
  source: /note="Description of Artificial Sequence: Synthetic oligonucleotide"
uaagcguaaaacaauacaguuua

SEQ ID NO: 1845 - RNA, 23 nt, Artificial Sequence
  source: /note="Description of Artificial Sequence: Synthetic oligonucleotide"
uaaagcguaaaacaauacaguuu

SEQ ID NO: 1846 - RNA, 23 nt, Artificial Sequence
  source: /note="Description of Artificial Sequence: Synthetic oligonucleotide"
uuaaagcguaaaacaauacaguu

SEQ ID NO: 1847 - RNA, 23 nt, Artificial Sequence
  source: /note="Description of Artificial Sequence: Synthetic oligonucleotide"
uuuaaagcguaaaacaauacagu

SEQ ID NO: 1848 - RNA, 23 nt, Artificial Sequence
  source: /note="Description of Artificial Sequence: Synthetic oligonucleotide"
uacagaauuagugguuucaaugg

SEQ ID NO: 1849 - RNA, 23 nt, Artificial Sequence
  source: /note="Description of Artificial Sequence: Synthetic oligonucleotide"
uaaaagggcuauuaaauaaguac

SEQ ID NO: 1850 - RNA, 23 nt, Artificial Sequence
  source: /note="Description of Artificial Sequence: Synthetic oligonucleotide"
uucggaaaacugcucuagagaca

SEQ ID NO: 1851 - RNA, 23 nt, Artificial Sequence
  source: /note="Description of Artificial Sequence: Synthetic oligonucleotide"
uuguacuacggaauaucucggaa

SEQ ID NO: 1852 - RNA, 23 nt, Artificial Sequence
  source: /note="Description of Artificial Sequence: Synthetic oligonucleotide"
uuuugaauaucaaaucccagagc

SEQ ID NO: 1853 - RNA, 23 nt, Artificial Sequence
  source: /note="Description of Artificial Sequence: Synthetic oligonucleotide"
uagucaaacauauccagugaaga

SEQ ID NO: 1854 - RNA, 23 nt, Artificial Sequence
  source: /note="Description of Artificial Sequence: Synthetic oligonucleotide"
ucguguuucuggaagugagccaa

SEQ ID NO: 1855 - RNA, 23 nt, Artificial Sequence
  source: /note="Description of Artificial Sequence: Synthetic oligonucleotide"
uguuugucguguuucuggaagug

SEQ ID NO: 1856 - RNA, 23 nt, Artificial Sequence
  source: /note="Description of Artificial Sequence: Synthetic oligonucleotide"
uaauuagugguuucaauggucug

SEQ ID NO: 1857 - RNA, 23 nt, Artificial Sequence
  source: /note="Description of Artificial Sequence: Synthetic oligonucleotide"
ucucaggacaagcuagugacugu

SEQ ID NO: 1858 - RNA, 23 nt, Artificial Sequence
  source: /note="Description of Artificial Sequence: Synthetic oligonucleotide"
uauuucaaaggaauguguggugg

SEQ ID NO: 1859 - RNA, 23 nt, Artificial Sequence
  source: /note="Description of Artificial Sequence: Synthetic oligonucleotide"
ugguuaaucggucuuuccgguga

SEQ ID NO: 1860 - RNA, 23 nt, Artificial Sequence
  source: /note="Description of Artificial Sequence: Synthetic oligonucleotide"
ugugacaugguuaaucggucuuu

SEQ ID NO: 1861 - RNA, 23 nt, Artificial Sequence
  source: /note="Description of Artificial Sequence: Synthetic oligonucleotide"
ugucaaacauauccagugaagac

SEQ ID NO: 1862 - RNA, 23 nt, Artificial Sequence
  source: /note="Description of Artificial Sequence: Synthetic oligonucleotide"
uuguuucuggaagugagccaacg

SEQ ID NO: 1863 - RNA, 23 nt, Artificial Sequence
  source: /note="Description of Artificial Sequence: Synthetic oligonucleotide"
ugucguguuucuggaagugagcc

SEQ ID NO: 1864 - RNA, 23 nt, Artificial Sequence
  source: /note="Description of Artificial Sequence: Synthetic oligonucleotide"
ugacaagcuagugacugucaccg

SEQ ID NO: 1865 - RNA, 23 nt, Artificial Sequence
  source: /note="Description of Artificial Sequence: Synthetic oligonucleotide"
ucggaaaacugcucuagagacaa

SEQ ID NO: 1866 - RNA, 23 nt, Artificial Sequence
  source: /note="Description of Artificial Sequence: Synthetic oligonucleotide"
ucucggaaaacugcucuagagac

SEQ ID NO: 1867 - RNA, 23 nt, Artificial Sequence
  source: /note="Description of Artificial Sequence: Synthetic oligonucleotide"
uuacggaauaucucggaaaacug

SEQ ID NO: 1868 - RNA, 23 nt, Artificial Sequence
  source: /note="Description of Artificial Sequence: Synthetic oligonucleotide"
uuacuacggaauaucucggaaaa

SEQ ID NO: 1869 - RNA, 23 nt, Artificial Sequence
  source: /note="Description of Artificial Sequence: Synthetic oligonucleotide"
ucguaaaacaauacaguuuaaga

SEQ ID NO: 1870 - RNA, 23 nt, Artificial Sequence
  source: /note="Description of Artificial Sequence: Synthetic oligonucleotide"
uagcguaaaacaauacaguuuaa

SEQ ID NO: 1871 - RNA, 23 nt, Artificial Sequence
  source: /note="Description of Artificial Sequence: Synthetic oligonucleotide"
uauauaagaaaauggcgaaucca

SEQ ID NO: 1872 - RNA, 23 nt, Artificial Sequence
  source: /note="Description of Artificial Sequence: Synthetic oligonucleotide"
ucagucaaacauauccagugaag

SEQ ID NO: 1873 - RNA, 23 nt, Artificial Sequence
  source: /note="Description of Artificial Sequence: Synthetic oligonucleotide"
uguuucuggaagugagccaacgu

SEQ ID NO: 1874 - RNA, 23 nt, Artificial Sequence
  source: /note="Description of Artificial Sequence: Synthetic oligonucleotide"
uuuugucguguuucuggaaguga

SEQ ID NO: 1875 - RNA, 23 nt, Artificial Sequence
  source: /note="Description of Artificial Sequence: Synthetic oligonucleotide"
uaaagggcuauuaaauaaguacc

SEQ ID NO: 1876 - RNA, 23 nt, Artificial Sequence
  source: /note="Description of Artificial Sequence: Synthetic oligonucleotide"
uauaucucggaaaacugcucuag

SEQ ID NO: 1877 - RNA, 23 nt, Artificial Sequence
  source: /note="Description of Artificial Sequence: Synthetic oligonucleotide"
ugguuugaauaucaaaucccaga

SEQ ID NO: 1878 - RNA, 23 nt, Artificial Sequence
  source: /note="Description of Artificial Sequence: Synthetic oligonucleotide"
uagguuugaauaucaaaucccag

SEQ ID NO: 1879 - RNA, 23 nt, Artificial Sequence
  source: /note="Description of Artificial Sequence: Synthetic oligonucleotide"
uagagguuugaauaucaaauccc

SEQ ID NO: 1880 - RNA, 23 nt, Artificial Sequence
  source: /note="Description of Artificial Sequence: Synthetic oligonucleotide"
ugcguaaaacaauacaguuuaag

SEQ ID NO: 1881 - RNA, 23 nt, Artificial Sequence
  source: /note="Description of Artificial Sequence: Synthetic oligonucleotide"
uuuaaucggucuuuccggugaga

SEQ ID NO: 1882 - RNA, 23 nt, Artificial Sequence
  source: /note="Description of Artificial Sequence: Synthetic oligonucleotide"
uguuaaucggucuuuccggugag

SEQ ID NO: 1883 - RNA, 23 nt, Artificial Sequence
  source: /note="Description of Artificial Sequence: Synthetic oligonucleotide"
uugguuaaucggucuuuccggug

SEQ ID NO: 1884 - RNA, 23 nt, Artificial Sequence
  source: /note="Description of Artificial Sequence: Synthetic oligonucleotide"
ugaaaauggcgaauccaguucca

SEQ ID NO: 1885 - RNA, 23 nt, Artificial Sequence
  source: /note="Description of Artificial Sequence: Synthetic oligonucleotide"
ugcagucaaacauauccagugaa

SEQ ID NO: 1886 - RNA, 23 nt, Artificial Sequence
  source: /note="Description of Artificial Sequence: Synthetic oligonucleotide"
uggucugaucacacaagguccuc

SEQ ID NO: 1887 - RNA, 23 nt, Artificial Sequence
  source: /note="Description of Artificial Sequence: Synthetic oligonucleotide"
uuagugguuucaauggucugauc

SEQ ID NO: 1888 - RNA, 23 nt, Artificial Sequence
  source: /note="Description of Artificial Sequence: Synthetic oligonucleotide"
ucagaauuagugguuucaauggu

SEQ ID NO: 1889 - RNA, 23 nt, Artificial Sequence
  source: /note="Description of Artificial Sequence: Synthetic oligonucleotide"
uaucucggaaaacugcucuagag

SEQ ID NO: 1890 - RNA, 23 nt, Artificial Sequence
  source: /note="Description of Artificial Sequence: Synthetic oligonucleotide"
uuaucucggaaaacugcucuaga

SEQ ID NO: 1891 - RNA, 23 nt, Artificial Sequence
  source: /note="Description of Artificial Sequence: Synthetic oligonucleotide"
uacggaauaucucggaaaacugc

SEQ ID NO: 1892 - RNA, 23 nt, Artificial Sequence
  source: /note="Description of Artificial Sequence: Synthetic oligonucleotide"
uuuuggugagguuugauccgcau

SEQ ID NO: 1893 - RNA, 23 nt, Artificial Sequence
  source: /note="Description of Artificial Sequence: Synthetic oligonucleotide"
uaucuuggacaaacaaaugcuuu

SEQ ID NO: 1894 - RNA, 23 nt, Artificial Sequence
  source: /note="Description of Artificial Sequence: Synthetic oligonucleotide"
uaaucggucuuuccggugagagg

SEQ ID NO: 1895 - RNA, 23 nt, Artificial Sequence
  source: /note="Description of Artificial Sequence: Synthetic oligonucleotide"
uucucggaaaacugcucuagaga

SEQ ID NO: 1896 - RNA, 23 nt, Artificial Sequence
  source: /note="Description of Artificial Sequence: Synthetic oligonucleotide"
uacgaaaaguuuccgugcaaucc

SEQ ID NO: 1897 - RNA, 23 nt, Artificial Sequence
  source: /note="Description of Artificial Sequence: Synthetic oligonucleotide"
uugaauaucaaaucccagagcac

SEQ ID NO: 1898 - RNA, 23 nt, Artificial Sequence
  source: /note="Description of Artificial Sequence: Synthetic oligonucleotide"
uuccgcucugaacaaggcucaca

SEQ ID NO: 1899 - RNA, 23 nt, Artificial Sequence
  source: /note="Description of Artificial Sequence: Synthetic oligonucleotide"
uucuccgcucugaacaaggcuca

SEQ ID NO: 1900 - RNA, 23 nt, Artificial Sequence
  source: /note="Description of Artificial Sequence: Synthetic oligonucleotide"
uggaucuuggacaaacaaaugcu

SEQ ID NO: 1901 - RNA, 23 nt, Artificial Sequence
  source: /note="Description of Artificial Sequence: Synthetic oligonucleotide"
ucaugguuaaucggucuuuccgg

SEQ ID NO: 1902 - RNA, 23 nt, Artificial Sequence
  source: /note="Description of Artificial Sequence: Synthetic oligonucleotide"
uacaugguuaaucggucuuuccg

SEQ ID NO: 1903 - RNA, 23 nt, Artificial Sequence
  source: /note="Description of Artificial Sequence: Synthetic oligonucleotide"
uugacaugguuaaucggucuuuc

SEQ ID NO: 1904 - RNA, 23 nt, Artificial Sequence
  source: /note="Description of Artificial Sequence: Synthetic oligonucleotide"
uggugacaugguuaaucggucuu

SEQ ID NO: 1905 - protein, 431 aa, Artificial Sequence
  source: /note="Description of Artificial Sequence: Synthetic polypeptide"
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1906 - protein, 252 aa, Artificial Sequence
  source: /note="Description of Artificial Sequence: Synthetic polypeptide"
MEIVMTQSPSTLSASVGDRVIITCQASEIIHSWLAWYQQKPGKAPKLLIYLASTLASGVPSRFSGSGSGAEFTLTISSLQPDDFATYYCQNVYLASTNGANFGQGTKLTVLGGGGGSGGGGSGGGGSGGGGSEVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSS

SEQ ID NO: 1907 - protein, 120 aa, Artificial Sequence
  source: /note="Description of Artificial Sequence: Synthetic polypeptide"
EVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSS

SEQ ID NO: 1908 - protein, 112 aa, Artificial Sequence
  source: /note="Description of Artificial Sequence: Synthetic polypeptide"
MEIVMTQSPSTLSASVGDRVIITCQASEIIHSWLAWYQQKPGKAPKLLIYLASTLASGVPSRFSGSGSGAEFTLTISSLQPDDFATYYCQNVYLASTNGANFGQGTKLTVLG

SEQ ID NO: 1909 - protein, 20 aa, Artificial Sequence
  source: /note="Description of Artificial Sequence: Synthetic peptide"
GGGGSGGGGSGGGGSGGGGS

SEQ ID NO: 1910 - protein, 231 aa, Artificial Sequence
  source: /note="Description of Artificial Sequence: Synthetic polypeptide"
EVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 1911 - protein, 214 aa, Artificial Sequence
  source: /note="Description of Artificial Sequence: Synthetic polypeptide"
DIQLTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1912 - protein, 123 aa, Artificial Sequence [sequence omitted]

SEQ ID NO: 1913 - protein, 107 aa, Artificial Sequence [sequence omitted]

SEQ ID NO: 1914 - RNA, 23 nt, Homo sapiens
cugguugugugugugugaguggu

SEQ ID NO: 1915 - RNA, 23 nt, Homo sapiens
uugugugugugugagugguugac

SEQ ID NO: 1916 - RNA, 23 nt, Homo sapiens
ugugugugugugagugguugacc

SEQ ID NO: 1917 - RNA, 23 nt, Homo sapiens
ugugugugugagugguugaccuu

SEQ ID NO: 1918 - RNA, 23 nt, Homo sapiens
ugugugugagugguugaccuucc

SEQ ID NO: 1919 - RNA, 23 nt, Homo sapiens
gugugugagugguugaccuuccu

SEQ ID NO: 1920 - RNA, 23 nt, Homo sapiens
ugugugagugguugaccuuccuc

SEQ ID NO: 1921 - RNA, 23 nt, Homo sapiens
ugugagugguugaccuuccucca

SEQ ID NO: 1922 - RNA, 23 nt, Homo sapiens
gagugguugaccuuccuccaucc

SEQ ID NO: 1923 - RNA, 23 nt, Homo sapiens
cauuguggaggcagagaaaagag

SEQ ID NO: 1924 - RNA, 23 nt, Homo sapiens
auuguggaggcagagaaaagaga

SEQ ID NO: 1925 - RNA, 23 nt, Homo sapiens
uuguggaggcagagaaaagagaa

SEQ ID NO: 1926 - RNA, 23 nt, Homo sapiens
uguggaggcagagaaaagagaaa

SEQ ID NO: 1927 - RNA, 23 nt, Homo sapiens
guggaggcagagaaaagagaaag

SEQ ID NO: 1928 - RNA, 23 nt, Homo sapiens
uggaggcagagaaaagagaaagu

SEQ ID NO: 1929 - RNA, 23 nt, Homo sapiens
ggaggcagagaaaagagaaagug

SEQ ID NO: 1930 - RNA, 23 nt, Homo sapiens
gaggcagagaaaagagaaagugu

SEQ ID NO: 1931 - RNA, 23 nt, Homo sapiens
aggcagagaaaagagaaaguguu

SEQ ID NO: 1932 - RNA, 23 nt, Homo sapiens
ggcagagaaaagagaaaguguuu

SEQ ID NO: 1933 - RNA, 23 nt, Homo sapiens
gcagagaaaagagaaaguguuuu

SEQ ID NO: 1934 - RNA, 23 nt, Homo sapiens
cagagaaaagagaaaguguuuua

SEQ ID NO: 1935 - RNA, 23 nt, Homo sapiens
agagaaaagagaaaguguuuuau

SEQ ID NO: 1936 - RNA, 23 nt, Homo sapiens
gagaaaagagaaaguguuuuaua

SEQ ID NO: 1937 - RNA, 23 nt, Homo sapiens
agaaaagagaaaguguuuuauau

SEQ ID NO: 1938 - RNA, 23 nt, Homo sapiens
gaaaagagaaaguguuuuauaua

SEQ ID NO: 1939 - RNA, 23 nt, Homo sapiens
aaaagagaaaguguuuuauauac

SEQ ID NO: 1940 - RNA, 23 nt, Homo sapiens
aaagagaaaguguuuuauauacg

SEQ ID NO: 1941 - RNA, 23 nt, Homo sapiens
aagagaaaguguuuuauauacgg

SEQ ID NO: 1942 - RNA, 23 nt, Homo sapiens
agagaaaguguuuuauauacggu

SEQ ID NO: 1943 - RNA, 23 nt, Homo sapiens
agaaaguguuuuauauacgguac

SEQ ID NO: 1944 - RNA, 23 nt, Homo sapiens
gaaaguguuuuauauacgguacu

SEQ ID NO: 1945 - RNA, 23 nt, Homo sapiens
aaaguguuuuauauacgguacuu

SEQ ID NO: 1946 - RNA, 23 nt, Homo sapiens
aaguguuuuauauacgguacuua

SEQ ID NO: 1947 - RNA, 23 nt, Homo sapiens
aguguuuuauauacgguacuuau

SEQ ID NO: 1948 - RNA, 23 nt, Homo sapiens
guguuuuauauacgguacuuauu

SEQ ID NO: 1949 - RNA, 23 nt, Homo sapiens
uguuuuauauacgguacuuauuu

SEQ ID NO: 1950 - RNA, 23 nt, Homo sapiens
guuuuauauacgguacuuauuua

SEQ ID NO: 1951 - protein, 30 aa, Artificial Sequence
  source: /note="Description of Artificial Sequence: Synthetic polypeptide"
  SITE (1)..(30): /note="This sequence may encompass 1-6 'Gly Gly Gly Gly Ser' repeating units"
  source: /note="See specification as filed for detailed description of substitutions and preferred embodiments"
GGGGSGGGGSGGGGSGGGGSGGGGSGGGGS

SEQ ID NO: 1952-1999 - skipped (48 entries)

SEQ ID NO: 2000 - RNA, 21 nt, Artificial Sequence
  source: /note="Description of Artificial Sequence: Synthetic oligonucleotide"
cggugcuggaauuugauauua

SEQ ID NO: 2001 - RNA, 21 nt, Artificial Sequence
  source: /note="Description of Artificial Sequence: Synthetic oligonucleotide"
ggugcuggaauuugauauuca

SEQ ID NO: 2002 - RNA, 21 nt, Artificial Sequence
  source: /note="Description of Artificial Sequence: Synthetic oligonucleotide"
ugcuggaauuugauauucaua

SEQ ID NO: 2003 - RNA, 21 nt, Artificial Sequence
  source: /note="Description of Artificial Sequence: Synthetic oligonucleotide"
gcuggaauuugauauucauua

SEQ ID NO: 2004 - RNA, 21 nt, Artificial Sequence
  source: /note="Description of Artificial Sequence: Synthetic oligonucleotide"
uggaauuugauauucauugaa

SEQ ID NO: 2005 - RNA, 21 nt, Artificial Sequence
  source: /note="Description of Artificial Sequence: Synthetic oligonucleotide"
ggaauuugauauucauugaua

SEQ ID NO: 2006 - RNA, 21 nt, Artificial Sequence
  source: /note="Description of Artificial Sequence: Synthetic oligonucleotide"
gaauuugauauucauugauca

SEQ ID NO: 2007 - RNA, 21 nt, Artificial Sequence
  source: /note="Description of Artificial Sequence: Synthetic oligonucleotide"
aauuugauauucauugaucca

SEQ ID NO: 2008 - RNA, 21 nt, Artificial Sequence
  source: /note="Description of Artificial Sequence: Synthetic oligonucleotide"
auuugauauucauugauccga

SEQ ID NO: 2009 - RNA, 21 nt, Artificial Sequence
  source: /note="Description of Artificial Sequence: Synthetic oligonucleotide"
uuugauauucauugauccgga

SEQ ID NO: 2010 - RNA, 21 nt, Artificial Sequence
  source: /note="Description of Artificial Sequence: Synthetic oligonucleotide"
uuuauuuuugcuugccauuca

SEQ ID NO: 2011 - RNA, 21 nt, Artificial Sequence
  source: /note="Description of Artificial Sequence: Synthetic oligonucleotide"
uuauuuuugcuugccauucca

SEQ ID NO: 2012 - RNA, 21 nt, Artificial Sequence
  source: /note="Description of Artificial Sequence: Synthetic oligonucleotide"
caaaucacuguggauuuugga

SEQ ID NO: 2013 - RNA, 21 nt, Artificial Sequence
  source: /note="Description of Artificial Sequence: Synthetic oligonucleotide"
aaaucacuguggauuuuggaa

SEQ ID NO: 2014 - RNA, 21 nt, Artificial Sequence
  source: /note="Description of Artificial Sequence: Synthetic oligonucleotide"
aaucacuguggauuuuggaaa

SEQ ID NO: 2015 - RNA, 21 nt, Artificial Sequence
  source: /note="Description of Artificial Sequence: Synthetic oligonucleotide"
aucacuguggauuuuggaaaa

SEQ ID NO: 2016 - RNA, 21 nt, Artificial Sequence
  source: /note="Description of Artificial Sequence: Synthetic oligonucleotide"
ucacuguggauuuuggaaaca

SEQ ID NO: 2017 - RNA, 21 nt, Artificial Sequence
  source: /note="Description of Artificial Sequence: Synthetic oligonucleotide"
cacuguggauuuuggaaacca

SEQ ID NO: 2018 - RNA, 21 nt, Artificial Sequence
  source: /note="Description of Artificial Sequence: Synthetic oligonucleotide"
acuguggauuuuggaaaccaa

SEQ ID NO: 2019 - RNA, 21 nt, Artificial Sequence
  source: /note="Description of Artificial Sequence: Synthetic oligonucleotide"
cuguggauuuuggaaaccaga

SEQ ID NO: 2020 - RNA, 21 nt, Artificial Sequence
  source: /note="Description of Artificial Sequence: Synthetic oligonucleotide"
uguggauuuuggaaaccagca

SEQ ID NO: 2021 - RNA, 21 nt, Artificial Sequence
  source: /note="Description of Artificial Sequence: Synthetic oligonucleotide"
guggauuuuggaaaccagcaa

SEQ ID NO: 2022 - RNA, 21 nt, Artificial Sequence
  source: /note="Description of Artificial Sequence: Synthetic oligonucleotide"
gauuuuggaaaccagcagaaa

SEQ ID NO: 2023 - RNA, 21 nt, Artificial Sequence
  source: /note="Description of Artificial Sequence: Synthetic oligonucleotide"
auuuuggaaaccagcagaaaa

SEQ ID NO: 2024 - RNA, 21 nt, Artificial Sequence
  source: /note="Description of Artificial Sequence: Synthetic oligonucleotide"
uuuuggaaaccagcagaaaga

SEQ ID NO: 2025 - RNA, 21 nt, Artificial Sequence
  source: /note="Description of Artificial Sequence: Synthetic oligonucleotide"
uuuggaaaccagcagaaagaa

SEQ ID NO: 2026 - RNA, 21 nt, Artificial Sequence
  source: /note="Description of Artificial Sequence: Synthetic oligonucleotide"
ggaaaccagcagaaagaggaa

SEQ ID NO: 2027 - RNA, 21 nt, Artificial Sequence
  source: /note="Description of Artificial Sequence: Synthetic oligonucleotide"
aaaccagcagaaagaggaaaa

SEQ ID NO: 2028 - RNA, 21 nt, Artificial Sequence
  source: /note="Description of Artificial Sequence: Synthetic oligonucleotide"
aaccagcagaaagaggaaaga

SEQ ID NO: 2029 - RNA, 21 nt, Artificial Sequence
  source: /note="Description of Artificial Sequence: Synthetic oligonucleotide"
accagcagaaagaggaaagaa

SEQ ID NO: 2030 - RNA, 21 nt, Artificial Sequence
  source: /note="Description of Artificial Sequence: Synthetic oligonucleotide"
ccagcagaaagaggaaagaga

SEQ ID NO: 2031 - RNA, 21 nt, Artificial Sequence
  source: /note="Description of Artificial Sequence: Synthetic oligonucleotide"
cagcagaaagaggaaagagga

SEQ ID NO: 2032 - RNA, 21 nt, Artificial Sequence
  source: /note="Description of Artificial Sequence: Synthetic oligonucleotide"
agcagaaagaggaaagaggua

SEQ ID NO: 2033 - RNA, 21 nt, Artificial Sequence
  source: /note="Description of Artificial Sequence: Synthetic oligonucleotide"
gcagaaagaggaaagagguaa

SEQ ID NO: 2034 - RNA, 21 nt, Artificial Sequence
  source: /note="Description of Artificial Sequence: Synthetic oligonucleotide"
cagaaagaggaaagagguaga

SEQ ID NO: 2035 - RNA, 21 nt, Artificial Sequence
  source: /note="Description of Artificial Sequence: Synthetic oligonucleotide"
aaagaggaaagagguagcaaa

SEQ ID NO: 2036 - RNA, 21 nt, Artificial Sequence
  source: /note="Description of Artificial Sequence: Synthetic oligonucleotide"
aagaggaaagagguagcaaga

SEQ ID NO: 2037 - RNA, 21 nt, Artificial Sequence
  source: /note="Description of Artificial Sequence: Synthetic oligonucleotide"
agaggaaagagguagcaagaa

SEQ ID NO: 2038 - RNA, 21 nt, Artificial Sequence
  source: /note="Description of Artificial Sequence: Synthetic oligonucleotide"
gaggaaagagguagcaagaga

SEQ ID NO: 2039 - RNA, 21 nt, Artificial Sequence
  source: /note="Description of Artificial Sequence: Synthetic oligonucleotide"
ggaaagagguagcaagagcua

SEQ ID NO: 2040 - RNA, 21 nt, Artificial Sequence
  source: /note="Description of Artificial Sequence: Synthetic oligonucleotide"
agguagcaagagcuccagaga

SEQ ID NO: 2041 - RNA, 21 nt, Artificial Sequence
  source: /note="Description of Artificial Sequence: Synthetic oligonucleotide"
uccagagagaagucgaggaaa

SEQ ID NO: 2042 - RNA, 21 nt, Artificial Sequence
  source: /note="Description of Artificial Sequence: Synthetic oligonucleotide"
ccagagagaagucgaggaaga

SEQ ID NO: 2043 - RNA, 21 nt, Artificial Sequence
  source: /note="Description of Artificial Sequence: Synthetic oligonucleotide"
cagagagaagucgaggaagaa

SEQ ID NO: 2044 - RNA, 21 nt, Artificial Sequence
  source: /note="Description of Artificial Sequence: Synthetic oligonucleotide"
agagaagucgaggaagagaga

SEQ ID NO: 2045 - RNA, 21 nt, Artificial Sequence
  source: /note="Description of Artificial Sequence: Synthetic oligonucleotide"
gagaagucgaggaagagagaa

SEQ ID NO: 2046 - RNA, 21 nt, Artificial Sequence
  source: /note="Description of Artificial Sequence: Synthetic oligonucleotide"
gaagucgaggaagagagagaa

SEQ ID NO: 2047 - RNA, 21 nt, Artificial Sequence
  source: /note="Description of Artificial Sequence: Synthetic oligonucleotide"
agugagugaccugcuuuugga

SEQ ID NO: 2048 - RNA, 21 nt, Artificial Sequence
  source: /note="Description of Artificial Sequence: Synthetic oligonucleotide"
ggcgucgcacugaaacuuuua

SEQ ID NO: 2049 - RNA, 21 nt, Artificial Sequence
  source: /note="Description of Artificial Sequence: Synthetic oligonucleotide"
gucgcacugaaacuuuucgua

SEQ ID NO: 2050 - RNA, 21 nt, Artificial Sequence
  source: /note="Description of Artificial Sequence: Synthetic oligonucleotide"
ucgcacugaaacuuuucguca

SEQ ID NO: 2051 - RNA, 21 nt, Artificial Sequence
  source: /note="Description of Artificial Sequence: Synthetic oligonucleotide"
cacugaaacuuuucguccaaa

SEQ ID NO: 2052 - RNA, 21 nt, Artificial Sequence
  source: /note="Description of Artificial Sequence: Synthetic oligonucleotide"
acugaaacuuuucguccaaca

SEQ ID NO: 2053 - RNA, 21 nt, Artificial Sequence
  source: /note="Description of Artificial Sequence: Synthetic oligonucleotide"
ugaaacuuuucguccaacuua

SEQ ID NO: 2054 - RNA, 21 nt, Artificial Sequence
  source: /note="Description of Artificial Sequence: Synthetic oligonucleotide"
aacuuuucguccaacuucuga

SEQ ID NO: 2055 - RNA, 21 nt, Artificial Sequence
  source: /note="Description of Artificial Sequence: Synthetic oligonucleotide"
cugggcuguucucgcuucgga

SEQ ID NO: 2056 - RNA, 21 nt, Artificial Sequence
  source: /note="Description of Artificial Sequence: Synthetic oligonucleotide"
ugggcuguucucgcuucggaa

SEQ ID NO: 2057 - RNA, 21 nt, Artificial Sequence
  source: /note="Description of Artificial Sequence: Synthetic oligonucleotide"
gggcuguucucgcuucggaga

SEQ ID NO: 2058 - RNA, 21 nt, Artificial Sequence
  source: /note="Description of Artificial Sequence: Synthetic oligonucleotide"
gcuguucucgcuucggaggaa

SEQ ID NO: 2059 - RNA, 21 nt, Artificial Sequence
  source: /note="Description of Artificial Sequence: Synthetic oligonucleotide"
gccgcgagaagugcuagcuca

SEQ ID NO: 2060 - RNA, 21 nt, Artificial Sequence
  source: /note="Description of Artificial Sequence: Synthetic oligonucleotide"
ccgcgagaagugcuagcucga

SEQ ID NO: 2061 - RNA, 21 nt, Artificial Sequence
  source: /note="Description of Artificial Sequence: Synthetic oligonucleotide"
gccuccgaaaccaugaacuua

SEQ ID NO: 2062 - RNA, 21 nt, Artificial Sequence
  source: /note="Description of Artificial Sequence: Synthetic oligonucleotide"
aaggaggagggcagaaucaua

SEQ ID NO: 2063 - RNA, 21 nt, Artificial Sequence
  source: /note="Description of Artificial Sequence: Synthetic oligonucleotide"
ggcagaaucaucacgaaguga

SEQ ID NO: 2064 - RNA, 21 nt, Artificial Sequence
  source: /note="Description of Artificial Sequence: Synthetic oligonucleotide"
aaucaucacgaaguggugaaa

SEQ ID NO: 2065 - RNA, 21 nt, Artificial Sequence
  source: /note="Description of Artificial Sequence: Synthetic oligonucleotide"
aucaucacgaaguggugaaga

SEQ ID NO: 2066 - RNA, 21 nt, Artificial Sequence
  source: /note="Description of Artificial Sequence: Synthetic oligonucleotide"
ucaucacgaaguggugaagua

SEQ ID NO: 2067 - RNA, 21 nt, Artificial Sequence
  source: /note="Description of Artificial Sequence: Synthetic oligonucleotide"
caucacgaaguggugaaguua

SEQ ID NO: 2068 - RNA, 21 nt, Artificial Sequence
  source: /note="Description of Artificial Sequence: Synthetic oligonucleotide"
ucacgaaguggugaaguucaa

SEQ ID NO: 2069 - RNA, 21 nt, Artificial Sequence
  source: /note="Description of Artificial Sequence: Synthetic oligonucleotide"
aaguggugaaguucauggaua

SEQ ID NO: 2070 - RNA, 21 nt, Artificial Sequence
  source: /note="Description of Artificial Sequence: Synthetic oligonucleotide"
aguggugaaguucauggauga

SEQ ID NO: 2071 - RNA, 21 nt, Artificial Sequence
  source: /note="Description of Artificial Sequence: Synthetic oligonucleotide"
guggugaaguucauggaugua

SEQ ID NO: 2072 - RNA, 21 nt, Artificial Sequence
  source: /note="Description of Artificial Sequence: Synthetic oligonucleotide"
ggugaaguucauggaugucua

SEQ ID NO: 2073 - RNA, 21 nt, Artificial Sequence
  source: /note="Description of Artificial Sequence: Synthetic oligonucleotide"
gugaaguucauggaugucuaa

SEQ ID NO: 2074 - RNA, 21 nt, Artificial Sequence
  source: /note="Description of Artificial Sequence: Synthetic oligonucleotide"
ugaaguucauggaugucuaua

SEQ ID NO: 2075 - RNA, 21 nt, Artificial Sequence
  source: /note="Description of Artificial Sequence: Synthetic oligonucleotide"
aaguucauggaugucuaucaa

SEQ ID NO: 2076 - RNA, 21 nt, Artificial Sequence
  source: /note="Description of Artificial Sequence: Synthetic oligonucleotide"
aguucauggaugucuaucaga

SEQ ID NO: 2077 - RNA, 21 nt, Artificial Sequence
  source: /note="Description of Artificial Sequence: Synthetic oligonucleotide"
uucauggaugucuaucagcga

SEQ ID NO: 2078 - RNA, 21 nt, Artificial Sequence
  source: /note="Description of Artificial Sequence: Synthetic oligonucleotide"
guggacaucuuccaggaguaa

SEQ ID NO: 2079 - RNA, 21 nt, Artificial Sequence
  source: /note="Description of Artificial Sequence: Synthetic oligonucleotide"
ucgaguacaucuucaagccaa

SEQ ID NO: 2080 - RNA, 21 nt, Artificial Sequence
  source: /note="Description of Artificial Sequence: Synthetic oligonucleotide"
cgaguacaucuucaagccaua

SEQ ID NO: 2081 - RNA, 21 nt, Artificial Sequence
  source: /note="Description of Artificial Sequence: Synthetic oligonucleotide"
gaguacaucuucaagccauca

SEQ ID NO: 2082 - RNA, 21 nt, Artificial Sequence
  source: /note="Description of Artificial Sequence: Synthetic oligonucleotide"
guacaucuucaagccauccua

SEQ ID NO: 2083 - RNA, 21 nt, Artificial Sequence
  source: /note="Description of Artificial Sequence: Synthetic oligonucleotide"
ccaacaucaccaugcagauua

SEQ ID NO: 2084 - RNA, 21 nt, Artificial Sequence
  source: /note="Description of Artificial Sequence: Synthetic oligonucleotide"
caacaucaccaugcagauuaa

SEQ ID NO: 2085 - RNA, 21 nt, Artificial Sequence
  source: /note="Description of Artificial Sequence: Synthetic oligonucleotide"
acaucaccaugcagauuauga

SEQ ID NO: 2086 - RNA, 21 nt, Artificial Sequence
  source: /note="Description of Artificial Sequence: Synthetic oligonucleotide"
caucaccaugcagauuaugca

SEQ ID NO: 2087 - RNA, 21 nt, Artificial Sequence
  source: /note="Description of Artificial Sequence: Synthetic oligonucleotide"
accaugcagauuaugcggaua

SEQ ID NO: 2088 - RNA, 21 nt, Artificial Sequence
  source: /note="Description of Artificial Sequence: Synthetic oligonucleotide"
augcagauuaugcggaucaaa

SEQ ID NO: 2089 - RNA, 21 nt, Artificial Sequence
  source: /note="Description of Artificial Sequence: Synthetic oligonucleotide"
ugcagauuaugcggaucaaaa

SEQ ID NO: 2090 - RNA, 21 nt, Artificial Sequence
  source: /note="Description of Artificial Sequence: Synthetic oligonucleotide"
gcagauuaugcggaucaaaca

SEQ ID NO: 2091 - RNA, 21 nt, Artificial Sequence
  source: /note="Description of Artificial Sequence: Synthetic oligonucleotide"
gauuaugcggaucaaaccuca

SEQ ID NO: 2092 - RNA, 21 nt, Artificial Sequence
  source: /note="Description of Artificial Sequence: Synthetic oligonucleotide"
auuaugcggaucaaaccucaa

SEQ ID NO: 2093 - RNA, 21 nt, Artificial Sequence
  source: /note="Description of Artificial Sequence: Synthetic oligonucleotide"
cggaucaaaccucaccaagga

SEQ ID NO: 2094 - RNA, 21 nt, Artificial Sequence
  source: /note="Description of Artificial Sequence: Synthetic oligonucleotide"
ggagagaugagcuuccuacaa

SEQ ID NO: 2095 - RNA, 21 nt, Artificial Sequence
  source: /note="Description of Artificial Sequence: Synthetic oligonucleotide"
gagaugagcuuccuacagcaa

SEQ ID NO: 2096 - RNA, 21 nt, Artificial Sequence
  source: /note="Description of Artificial Sequence: Synthetic oligonucleotide"
gaugagcuuccuacagcacaa

SEQ ID NO: 2097 - RNA, 21 nt, Artificial Sequence
  source: /note="Description of Artificial Sequence: Synthetic oligonucleotide"
augagcuuccuacagcacaaa

SEQ ID NO: 2098 - RNA, 21 nt, Artificial Sequence
  source: /note="Description of Artificial Sequence: Synthetic oligonucleotide"
gagcuuccuacagcacaacaa

SEQ ID NO: 2099 - RNA, 21 nt, Artificial Sequence
  source: /note="Description of Artificial Sequence: Synthetic oligonucleotide"
agcuuccuacagcacaacaaa

SEQ ID NO: 2100 - RNA, 21 nt, Artificial Sequence
  source: /note="Description of Artificial Sequence: Synthetic oligonucleotide"
gcuuccuacagcacaacaaaa

SEQ ID NO: 2101 - RNA, 21 nt, Artificial Sequence
  source: /note="Description of Artificial Sequence: Synthetic oligonucleotide"
cuuccuacagcacaacaaaua

SEQ ID NO: 2102 - RNA, 21 nt, Artificial Sequence
  source: /note="Description of Artificial Sequence: Synthetic oligonucleotide"
uccuacagcacaacaaaugua

SEQ ID NO: 2103 - RNA, 21 nt, Artificial Sequence
  source: /note="Description of Artificial Sequence: Synthetic oligonucleotide"
cuacagcacaacaaaugugaa

SEQ ID NO: 2104 - RNA, 21 nt, Artificial Sequence
  source: /note="Description of Artificial Sequence: Synthetic oligonucleotide"
uacagcacaacaaaugugaaa

SEQ ID NO: 2105 - RNA, 21 nt, Artificial Sequence
  source: /note="Description of Artificial Sequence: Synthetic oligonucleotide"
agcacaacaaaugugaaugca

SEQ ID NO: 2106 - RNA, 21 nt, Artificial Sequence
  source: /note="Description of Artificial Sequence: Synthetic oligonucleotide"
gcacaacaaaugugaaugcaa

SEQ ID NO: 2107 - RNA, 21 nt, Artificial Sequence
  source: /note="Description of Artificial Sequence: Synthetic oligonucleotide"
cucaccaggaaagacugauaa

SEQ ID NO: 2108 - RNA, 21 nt, Artificial Sequence
  source: /note="Description of Artificial Sequence: Synthetic oligonucleotide"
ucaccaggaaagacugauaca

SEQ ID NO: 2109 - RNA, 21 nt, Artificial Sequence
  source: /note="Description of Artificial Sequence: Synthetic oligonucleotide"
caccaggaaagacugauacaa

SEQ ID NO: 2110 - RNA, 21 nt, Artificial Sequence
  source: /note="Description of Artificial Sequence: Synthetic oligonucleotide"
accaggaaagacugauacaga

SEQ ID NO: 2111 - RNA, 21 nt, Artificial Sequence
  source: /note="Description of Artificial Sequence: Synthetic oligonucleotide"
ccaggaaagacugauacagaa

SEQ ID NO: 2112 - RNA, 21 nt, Artificial Sequence
  source: /note="Description of Artificial Sequence: Synthetic oligonucleotide"
caggaaagacugauacagaaa

SEQ ID NO: 2113 - RNA, 21 nt, Artificial Sequence
  source: /note="Description of Artificial Sequence: Synthetic oligonucleotide"
aggaaagacugauacagaaca

SEQ ID NO: 2114 - RNA, 21 nt, Artificial Sequence
  source: /note="Description of Artificial Sequence: Synthetic oligonucleotide"
ggaaagacugauacagaacga

SEQ ID NO: 2115 - RNA, 21 nt, Artificial Sequence
  source: /note="Description of Artificial Sequence: Synthetic oligonucleotide"
gaaagacugauacagaacgaa

SEQ ID NO: 2116 - RNA, 21 nt, Artificial Sequence
  source: /note="Description of Artificial Sequence: Synthetic oligonucleotide"
aaagacugauacagaacgaua

SEQ ID NO: 2117 - RNA, 21 nt, Artificial Sequence
  source: /note="Description of Artificial Sequence: Synthetic oligonucleotide"
aagacugauacagaacgauca

SEQ ID NO: 2118 - RNA, 21 nt, Artificial Sequence
  source: /note="Description of Artificial Sequence: Synthetic oligonucleotide"
agacugauacagaacgaucga

SEQ ID NO: 2119 - RNA, 21 nt, Artificial Sequence
  source: /note="Description of Artificial Sequence: Synthetic oligonucleotide"
gacugauacagaacgaucgaa

SEQ ID NO: 2120 - RNA, 21 nt, Artificial Sequence
  source: /note="Description of Artificial Sequence: Synthetic oligonucleotide"
acugauacagaacgaucgaua

SEQ ID NO: 2121 - RNA, 21 nt, Artificial Sequence
  source: /note="Description of Artificial Sequence: Synthetic oligonucleotide"
cugauacagaacgaucgauaa

SEQ ID NO: 2122 - RNA, 21 nt, Artificial Sequence
  source: /note="Description of Artificial Sequence: Synthetic oligonucleotide"
ugauacagaacgaucgauaca

SEQ ID NO: 2123 - RNA, 21 nt, Artificial Sequence
  source: /note="Description of Artificial Sequence: Synthetic oligonucleotide"
gauacagaacgaucgauacaa

SEQ ID NO: 2124 - RNA, 21 nt, Artificial Sequence
  source: /note="Description of Artificial Sequence: Synthetic oligonucleotide"
auacagaacgaucgauacaga

SEQ ID NO: 2125 - RNA, 21 nt, Artificial Sequence
  source: /note="Description of Artificial Sequence: Synthetic oligonucleotide"
uacagaacgaucgauacagaa

SEQ ID NO: 2126 - RNA, 21 nt, Artificial Sequence
  source: /note="Description of Artificial Sequence: Synthetic oligonucleotide"
acagaacgaucgauacagaaa

SEQ ID NO: 2127 - RNA, 21 nt, Artificial Sequence
  source: /note="Description of Artificial Sequence: Synthetic oligonucleotide"
cagaacgaucgauacagaaaa

SEQ ID NO: 2128 - RNA, 21 nt, Artificial Sequence
  source: /note="Description of Artificial Sequence: Synthetic oligonucleotide"
agaacgaucgauacagaaaca

SEQ ID NO: 2129 - RNA, 21 nt, Artificial Sequence
  source: /note="Description of Artificial Sequence: Synthetic oligonucleotide"
gaacgaucgauacagaaacca

SEQ ID NO: 2130 - RNA, 21 nt, Artificial Sequence
  source: /note="Description of Artificial Sequence: Synthetic oligonucleotide"
aacgaucgauacagaaaccaa

SEQ ID NO: 2131 - RNA, 21 nt, Artificial Sequence
  source: /note="Description of Artificial Sequence: Synthetic oligonucleotide"
acgaucgauacagaaaccaca

SEQ ID NO: 2132 - RNA, 21 nt, Artificial Sequence
  source: /note="Description of Artificial Sequence: Synthetic oligonucleotide"
cgaucgauacagaaaccacga

SEQ ID NO: 2133 - RNA, 21 nt, Artificial Sequence
  source: /note="Description of Artificial Sequence: Synthetic oligonucleotide"
caccaucaccaucgacagaaa

SEQ ID NO: 2134 - RNA, 21 nt, Artificial Sequence
  source: /note="Description of Artificial Sequence: Synthetic oligonucleotide"
caucaccaucgacagaacaga

SEQ ID NO: 2135 - RNA, 21 nt, Artificial Sequence
  source: /note="Description of Artificial Sequence: Synthetic oligonucleotide"
ucaccaucgacagaacaguca

SEQ ID NO: 2136 - RNA, 21 nt, Artificial Sequence
  source: /note="Description of Artificial Sequence: Synthetic oligonucleotide"
caccaucgacagaacagucca

SEQ ID NO: 2137 - RNA, 21 nt, Artificial Sequence
  source: /note="Description of Artificial Sequence: Synthetic oligonucleotide"
accaucgacagaacaguccua

SEQ ID NO: 2138 - RNA, 21 nt, Artificial Sequence
  source: /note="Description of Artificial Sequence: Synthetic oligonucleotide"
ccaucgacagaacaguccuua

SEQ ID NO: 2139 - RNA, 21 nt, Artificial Sequence
  source: /note="Description of Artificial Sequence: Synthetic oligonucleotide"
caucgacagaacaguccuuaa

SEQ ID NO: 2140 - RNA, 21 nt, Artificial Sequence
  source: /note="Description of Artificial Sequence: Synthetic oligonucleotide"
aucgacagaacaguccuuaaa

SEQ ID NO: 2141 - RNA, 21 nt, Artificial Sequence
  source: /note="Description of Artificial Sequence: Synthetic oligonucleotide"
ucgacagaacaguccuuaaua

SEQ ID NO: 2142 - RNA, 21 nt, Artificial Sequence
  source: /note="Description of Artificial Sequence: Synthetic oligonucleotide"
cgacagaacaguccuuaauca

SEQ ID NO: 2143 - RNA, 21 nt, Artificial Sequence
  source: /note="Description of Artificial Sequence: Synthetic oligonucleotide"
gacagaacaguccuuaaucca

SEQ ID NO: 2144 - RNA, 21 nt, Artificial Sequence
  source: /note="Description of Artificial Sequence: Synthetic oligonucleotide"
acagaacaguccuuaauccaa

SEQ ID NO: 2145 - RNA, 21 nt, Artificial Sequence
  source: /note="Description of Artificial Sequence: Synthetic oligonucleotide"
agaacaguccuuaauccagaa

SEQ ID NO: 2146 - RNA, 21 nt, Artificial Sequence
  source: /note="Description of Artificial Sequence: Synthetic oligonucleotide"
gaacaguccuuaauccagaaa

SEQ ID NO: 2147 - RNA, 21 nt, Artificial Sequence
  source: /note="Description of Artificial Sequence: Synthetic oligonucleotide"
aacaguccuuaauccagaaaa

SEQ ID NO: 2148 - RNA, 21 nt, Artificial Sequence
  source: /note="Description of Artificial Sequence: Synthetic oligonucleotide"
acaguccuuaauccagaaaca

SEQ ID NO: 2149 - RNA, 21 nt, Artificial Sequence
  source: /note="Description of Artificial Sequence: Synthetic oligonucleotide"
caguccuuaauccagaaacca

SEQ ID NO: 2150 - RNA, 21 nt, Artificial Sequence
  source: /note="Description of Artificial Sequence: Synthetic oligonucleotide"
aguccuuaauccagaaaccua

SEQ ID NO: 2151 - RNA, 21 nt, Artificial Sequence
  source: /note="Description of Artificial Sequence: Synthetic oligonucleotide"
guccuuaauccagaaaccuga

SEQ ID NO: 2152 - RNA, 21 nt, Artificial Sequence
  source: /note="Description of Artificial Sequence: Synthetic oligonucleotide"
uccuuaauccagaaaccugaa

SEQ ID NO: 2153 - RNA, 21 nt, Artificial Sequence
  source: /note="Description of Artificial Sequence: Synthetic oligonucleotide"
ccuuaauccagaaaccugaaa

SEQ ID NO: 2154 - RNA, 21 nt, Artificial Sequence
  source: /note="Description of Artificial Sequence: Synthetic oligonucleotide"
cuuaauccagaaaccugaaaa

SEQ ID NO: 2155 - RNA, 21 nt, Artificial Sequence
  source: /note="Description of Artificial Sequence: Synthetic oligonucleotide"
uuaauccagaaaccugaaaua

SEQ ID NO: 2156 - RNA, 21 nt, Artificial Sequence
  source: /note="Description of Artificial Sequence: Synthetic oligonucleotide"
cagaaaccugaaaugaaggaa

SEQ ID NO: 2157 - RNA, 21 nt, Artificial Sequence
  source: /note="Description of Artificial Sequence: Synthetic oligonucleotide"
agaaaccugaaaugaaggaaa

SEQ ID NO: 2158 - RNA, 21 nt, Artificial Sequence
  source: /note="Description of Artificial Sequence: Synthetic oligonucleotide"
gaaaccugaaaugaaggaaga

SEQ ID NO: 2159 - RNA, 21 nt, Artificial Sequence
  source: /note="Description of Artificial Sequence: Synthetic oligonucleotide"
aaaccugaaaugaaggaagaa

SEQ ID NO: 2160 - RNA, 21 nt, Artificial Sequence
  source: /note="Description of Artificial Sequence: Synthetic oligonucleotide"
aaccugaaaugaaggaagaga

SEQ ID NO: 2161 - RNA, 21 nt, Artificial Sequence
  source: /note="Description of Artificial Sequence: Synthetic oligonucleotide"
ccugaaaugaaggaagaggaa

SEQ ID NO: 2162 - RNA, 21 nt, Artificial Sequence
  source: /note="Description of Artificial Sequence: Synthetic oligonucleotide"
augaaggaagaggagacucua

SEQ ID NO: 2163 - RNA, 21 nt, Artificial Sequence
  source: /note="Description of Artificial Sequence: Synthetic oligonucleotide"
ucccucuuggaauuggauuca

SEQ ID NO: 2164 - RNA, 21 nt, Artificial Sequence
  source: /note="Description of Artificial Sequence: Synthetic oligonucleotide"
ccucuuggaauuggauucgca

SEQ ID NO: 2165 - RNA, 21 nt, Artificial Sequence
  source: /note="Description of Artificial Sequence: Synthetic oligonucleotide"
cucuuggaauuggauucgcca

SEQ ID NO: 2166 - RNA, 21 nt, Artificial Sequence
  source: /note="Description of Artificial Sequence: Synthetic oligonucleotide"
uuggaauuggauucgccauua

SEQ ID NO: 2167 - RNA, 21 nt, Artificial Sequence
  source: /note="Description of Artificial Sequence: Synthetic oligonucleotide"
uggaauuggauucgccauuua

SEQ ID NO: 2168 - RNA, 21 nt, Artificial Sequence
  source: /note="Description of Artificial Sequence: Synthetic oligonucleotide"
ggaauuggauucgccauuuua

SEQ ID NO: 2169 - RNA, 21 nt, Artificial Sequence
  source: /note="Description of Artificial Sequence: Synthetic oligonucleotide"
gaauuggauucgccauuuuaa

SEQ ID NO: 2170 - RNA, 21 nt, Artificial Sequence
  source: /note="Description of Artificial Sequence: Synthetic oligonucleotide"
aauuggauucgccauuuuaua

SEQ ID NO: 2171 - RNA, 21 nt, Artificial Sequence
  source: /note="Description of Artificial Sequence: Synthetic oligonucleotide"
auuggauucgccauuuuauua

SEQ ID NO: 2172 - RNA, 21 nt, Artificial Sequence
  source: /note="Description of Artificial Sequence: Synthetic oligonucleotide"
uuggauucgccauuuuauuua

SEQ ID NO: 2173 - RNA, 21 nt, Artificial Sequence
  source: /note="Description of Artificial Sequence: Synthetic oligonucleotide"
uggauucgccauuuuauuuua

SEQ ID NO: 2174 - RNA, 21 nt, Artificial Sequence
  source: /note="Description of Artificial Sequence: Synthetic oligonucleotide"
ggauucgccauuuuauuuuua

SEQ ID NO: 2175 - RNA, 21 nt, Artificial Sequence
  source: /note="Description of Artificial Sequence: Synthetic oligonucleotide"
gauucgccauuuuauuuuuca

SEQ ID NO: 2176 - RNA, 21 nt, Artificial Sequence
  source: /note="Description of Artificial Sequence: Synthetic oligonucleotide"
ucgccauuuuauuuuucuuga

SEQ ID NO: 2177 - RNA, 21 nt, Artificial Sequence
  source: /note="Description of Artificial Sequence: Synthetic oligonucleotide"
cgccauuuuauuuuucuugca

SEQ ID NO: 2178 - RNA, 21 nt, Artificial Sequence
  source: /note="Description of Artificial Sequence: Synthetic oligonucleotide"
gccauuuuauuuuucuugcua

SEQ ID NO: 2179 - RNA, 21 nt, Artificial Sequence
  source: /note="Description of Artificial Sequence: Synthetic oligonucleotide"
ccauuuuauuuuucuugcuga

SEQ ID NO: 2180 - RNA, 21 nt, Artificial Sequence
  source: /note="Description of Artificial Sequence: Synthetic oligonucleotide"
cauuuuauuuuucuugcugca

SEQ ID NO: 2181 - RNA, 21 nt, Artificial Sequence
  source: /note="Description of Artificial Sequence: Synthetic oligonucleotide"
auuuuauuuuucuugcugcua

SEQ ID NO: 2182 - RNA, 21 nt, Artificial Sequence
  source: /note="Description of Artificial Sequence: Synthetic oligonucleotide"
uuuuauuuuucuugcugcuaa

SEQ ID NO: 2183 - RNA, 21 nt, Artificial Sequence
  source: /note="Description of Artificial Sequence: Synthetic oligonucleotide"
uuucuugcugcuaaaucacca

SEQ ID NO: 2184 - RNA, 21 nt, Artificial Sequence
  source: /note="Description of Artificial Sequence: Synthetic oligonucleotide"
ucaccgagcccggaagauuaa

SEQ ID NO: 2185 - RNA, 21 nt, Artificial Sequence
  source: /note="Description of Artificial Sequence: Synthetic oligonucleotide"
gcccggaagauuagagaguua

SEQ ID NO: 2186 - RNA, 21 nt, Artificial Sequence
  source: /note="Description of Artificial Sequence: Synthetic oligonucleotide"
cccggaagauuagagaguuua

SEQ ID NO: 2187 - RNA, 21 nt, Artificial Sequence
  source: /note="Description of Artificial Sequence: Synthetic oligonucleotide"
cggaagauuagagaguuuuaa

SEQ ID NO: 2188 - RNA, 21 nt, Artificial Sequence
  source: /note="Description of Artificial Sequence: Synthetic oligonucleotide"
ggaagauuagagaguuuuaua

SEQ ID NO: 2189 - RNA, 21 nt, Artificial Sequence
  source: /note="Description of Artificial Sequence: Synthetic oligonucleotide"
gaagauuagagaguuuuauua

SEQ ID NO: 2190 - RNA, 21 nt, Artificial Sequence
  source: /note="Description of Artificial Sequence: Synthetic oligonucleotide"
aagauuagagaguuuuauuua

SEQ ID NO: 2191 - RNA, 21 nt, Artificial Sequence
  source: /note="Description of Artificial Sequence: Synthetic oligonucleotide"
agauuagagaguuuuauuuca

SEQ ID NO: 2192 - RNA, 21 nt, Artificial Sequence
  source: /note="Description of Artificial Sequence: Synthetic oligonucleotide"
auuagagaguuuuauuucuga

SEQ ID NO: 2193 - RNA, 21 nt, Artificial Sequence
  source: /note="Description of Artificial Sequence: Synthetic oligonucleotide"
uuagagaguuuuauuucugga

SEQ ID NO: 2194 - RNA, 21 nt, Artificial Sequence
  source: /note="Description of Artificial Sequence: Synthetic oligonucleotide"
uagagaguuuuauuucuggga

SEQ ID NO: 2195 - RNA, 21 nt, Artificial Sequence
  source: /note="Description of Artificial Sequence: Synthetic oligonucleotide"
agagaguuuuauuucugggaa

SEQ ID NO: 2196 - RNA, 21 nt, Artificial Sequence
  source: /note="Description of Artificial Sequence: Synthetic oligonucleotide"
gagaguuuuauuucugggaua

SEQ ID NO: 2197 - RNA, 21 nt, Artificial Sequence
  source: /note="Description of Artificial Sequence: Synthetic oligonucleotide"
agaguuuuauuucugggauua

SEQ ID NO: 2198 - RNA, 21 nt, Artificial Sequence
  source: /note="Description of Artificial Sequence: Synthetic oligonucleotide"
gaguuuuauuucugggauuca

SEQ ID NO: 2199 - RNA, 21 nt, Artificial Sequence
  source: /note="Description of Artificial Sequence: Synthetic oligonucleotide"
aguuuuauuucugggauucca

SEQ ID NO: 2200 - RNA, 21 nt, Artificial Sequence
  source: /note="Description of Artificial Sequence: Synthetic oligonucleotide"
guuuuauuucugggauuccua

SEQ ID NO: 2201 - RNA, 21 nt, Artificial Sequence
  source: /note="Description of Artificial Sequence: Synthetic oligonucleotide"
uuuuauuucugggauuccuga

SEQ ID NO: 2202 - RNA, 21 nt, Artificial Sequence
  source: /note="Description of Artificial Sequence: Synthetic oligonucleotide"
uuuauuucugggauuccugua

SEQ ID NO: 2203 - RNA, 21 nt, Artificial Sequence
  source: /note="Description of Artificial Sequence: Synthetic oligonucleotide"
uuauuucugggauuccuguaa

SEQ ID NO: 2204 - RNA, 21 nt, Artificial Sequence
  source: /note="Description of Artificial Sequence: Synthetic oligonucleotide"
uauuucugggauuccuguaga

SEQ ID NO: 2205 - RNA, 21 nt, Artificial Sequence
  source: /note="Description of Artificial Sequence: Synthetic oligonucleotide"
auuucugggauuccuguagaa

SEQ ID NO: 2206 - RNA, 21 nt, Artificial Sequence
  source: /note="Description of Artificial Sequence: Synthetic oligonucleotide"
uuucugggauuccuguagaca

SEQ ID NO: 2207 - RNA, 21 nt, Artificial Sequence
  source: /note="Description of Artificial Sequence: Synthetic oligonucleotide"
ucugggauuccuguagacaca

SEQ ID NO: 2208 - RNA, 21 nt, Artificial Sequence
  source: /note="Description of Artificial Sequence: Synthetic oligonucleotide"
cugggauuccuguagacacaa

SEQ ID NO: 2209 - RNA, 21 nt, Artificial Sequence
  source: /note="Description of Artificial Sequence: Synthetic oligonucleotide"
ugggauuccuguagacacaca

SEQ ID NO: 2210 - RNA, 21 nt, Artificial Sequence
  source: /note="Description of Artificial Sequence: Synthetic oligonucleotide"
gggauuccuguagacacacca

SEQ ID NO: 2211 - RNA, 21 nt, Artificial Sequence
  source: /note="Description of Artificial Sequence: Synthetic oligonucleotide"
acacacccacccacauacaua

SEQ ID NO: 2212 - RNA, 21 nt, Artificial Sequence
  source: /note="Description of Artificial Sequence: Synthetic oligonucleotide"
acccacccacauacauacaua

SEQ ID NO: 2213 - RNA, 21 nt, Artificial Sequence
  source: /note="Description of Artificial Sequence: Synthetic oligonucleotide"
cccacccacauacauacauua

SEQ ID NO: 2214 - RNA, 21 nt, Artificial Sequence
  source: /note="Description of Artificial Sequence: Synthetic oligonucleotide"
ccacccacauacauacauuua

SEQ ID NO: 2215 - RNA, 21 nt, Artificial Sequence
  source: /note="Description of Artificial Sequence: Synthetic oligonucleotide"
cacccacauacauacauuuaa

SEQ ID NO: 2216 - RNA, 21 nt, Artificial Sequence
  source: /note="Description of Artificial Sequence: Synthetic oligonucleotide"
ccacauacauacauuuauaua

SEQ ID NO: 2217 - RNA, 21 nt, Artificial Sequence
  source: /note="Description of Artificial Sequence: Synthetic oligonucleotide"
cacauacauacauuuauauaa

SEQ ID NO: 2218 - RNA, 21 nt, Artificial Sequence
  source: /note="Description of Artificial Sequence: Synthetic oligonucleotide"
uuaaauuaacagugcuaauga

SEQ ID NO: 2219 - RNA, 21 nt, Artificial Sequence
  source: /note="Description of Artificial Sequence: Synthetic oligonucleotide"
uaaauuaacagugcuaaugua

SEQ ID NO: 2220 - RNA, 21 nt, Artificial Sequence
  source: /note="Description of Artificial Sequence: Synthetic oligonucleotide"
aaauuaacagugcuaauguua

SEQ ID NO: 2221 - RNA, 21 nt, Artificial Sequence
  source: /note="Description of Artificial Sequence: Synthetic oligonucleotide"
aauuaacagugcuaauguuaa

SEQ ID NO: 2222 - RNA, 21 nt, Artificial Sequence
  source: /note="Description of Artificial Sequence: Synthetic oligonucleotide"
auuaacagugcuaauguuaua

SEQ ID NO: 2223 - RNA, 21 nt, Artificial Sequence
  source: /note="Description of Artificial Sequence: Synthetic oligonucleotide"
uuaacagugcuaauguuauua

SEQ ID NO: 2224 - RNA, 21 nt, Artificial Sequence
  source: /note="Description of Artificial Sequence: Synthetic oligonucleotide"
uaacagugcuaauguuauuga

SEQ ID NO: 2225 - RNA, 21 nt, Artificial Sequence
  source: /note="Description of Artificial Sequence: Synthetic oligonucleotide"
aacagugcuaauguuauugga

SEQ ID NO: 2226 - RNA, 21 nt, Artificial Sequence
  source: /note="Description of Artificial Sequence: Synthetic oligonucleotide"
acagugcuaauguuauuggua

SEQ ID NO: 2227 - RNA, 21 nt, Artificial Sequence
  source: /note="Description of Artificial Sequence: Synthetic oligonucleotide"
cagugcuaauguuauugguga

SEQ ID NO: 2228 - RNA, 21 nt, Artificial Sequence
  source: /note="Description of Artificial Sequence: Synthetic oligonucleotide"
gugcuaauguuauugguguca

SEQ ID NO: 2229 - RNA, 21 nt, Artificial Sequence
  source: /note="Description of Artificial Sequence: Synthetic oligonucleotide"
ugcuaauguuauuggugucua

SEQ ID NO: 2230 - RNA, 21 nt, Artificial Sequence
  source: /note="Description of Artificial Sequence: Synthetic oligonucleotide"
gcuaauguuauuggugucuua

SEQ ID NO: 2231 - RNA, 21 nt, Artificial Sequence
  source: /note="Description of Artificial Sequence: Synthetic oligonucleotide"
cuaauguuauuggugucuuca

SEQ ID NO: 2232 - RNA, 21 nt, Artificial Sequence
  source: /note="Description of Artificial Sequence: Synthetic oligonucleotide"
uaauguuauuggugucuucaa

SEQ ID NO: 2233 - RNA, 21 nt, Artificial Sequence
  source: /note="Description of Artificial Sequence: Synthetic oligonucleotide"
aauguuauuggugucuucaca

SEQ ID NO: 2234 - RNA, 21 nt, Artificial Sequence
  source: /note="Description of Artificial Sequence: Synthetic oligonucleotide"
auguuauuggugucuucacua

SEQ ID NO: 2235 - RNA, 21 nt, Artificial Sequence
  source: /note="Description of Artificial Sequence: Synthetic oligonucleotide"
uguuauuggugucuucacuga

SEQ ID NO: 2236 - RNA, 21 nt, Artificial Sequence
  source: /note="Description of Artificial Sequence: Synthetic oligonucleotide"
guuauuggugucuucacugga

SEQ ID NO: 2237 - RNA, 21 nt, Artificial Sequence
  source: /note="Description of Artificial Sequence: Synthetic oligonucleotide"
uuauuggugucuucacuggaa

SEQ ID NO: 2238 - RNA, 21 nt, Artificial Sequence
  source: /note="Description of Artificial Sequence: Synthetic oligonucleotide"
uggugucuucacuggauguaa

SEQ ID NO: 2239 - RNA, 21 nt, Artificial Sequence
  source: /note="Description of Artificial Sequence: Synthetic oligonucleotide"
ugucuucacuggauguauuua

SEQ ID NO: 2240 - RNA, 21 nt, Artificial Sequence
  source: /note="Description of Artificial Sequence: Synthetic oligonucleotide"
cacuggauguauuugacugca

SEQ ID NO: 2241 - RNA, 21 nt, Artificial Sequence
  source: /note="Description of Artificial Sequence: Synthetic oligonucleotide"
acuggauguauuugacugcua

SEQ ID NO: 2242 - RNA, 21 nt, Artificial Sequence
  source: /note="Description of Artificial Sequence: Synthetic oligonucleotide"
uggauguauuugacugcugua

SEQ ID NO: 2243 - RNA, 21 nt, Artificial Sequence
  source: /note="Description of Artificial Sequence: Synthetic oligonucleotide"
uauuugacugcuguggacuua

SEQ ID NO: 2244 - RNA, 21 nt, Artificial Sequence
  source: /note="Description of Artificial Sequence: Synthetic oligonucleotide"
uuugacugcuguggacuugaa

SEQ ID NO: 2245 - RNA, 21 nt, Artificial Sequence
  source: /note="Description of Artificial Sequence: Synthetic oligonucleotide"
gcuguggacuugaguugggaa

SEQ ID NO: 2246 - RNA, 21 nt, Artificial Sequence
  source: /note="Description of Artificial Sequence: Synthetic oligonucleotide"
ucccacucagauccugacaga

SEQ ID NO: 2247 - RNA, 21 nt, Artificial Sequence
  source: /note="Description of Artificial Sequence: Synthetic oligonucleotide"
cccacucagauccugacagga

SEQ ID NO: 2248 - RNA, 21 nt, Artificial Sequence
  source: /note="Description of Artificial Sequence: Synthetic oligonucleotide"
ggaggagaugagagacucuga

SEQ ID NO: 2249 - RNA, 21 nt, Artificial Sequence
  source: /note="Description of Artificial Sequence: Synthetic oligonucleotide"
gaggagaugagagacucugga

SEQ ID NO: 2250 - RNA, 21 nt, Artificial Sequence
  source: /note="Description of Artificial Sequence: Synthetic oligonucleotide"
ggagaugagagacucuggcaa

SEQ ID NO: 2251 - RNA, 21 nt, Artificial Sequence
  source: /note="Description of Artificial Sequence: Synthetic oligonucleotide"
gagacucuggcaugaucuuua

SEQ ID NO: 2252 - RNA, 21 nt, Artificial Sequence
  source: /note="Description of Artificial Sequence: Synthetic oligonucleotide"
agacucuggcaugaucuuuua

SEQ ID NO: 2253 - RNA, 21 nt, Artificial Sequence
  source: /note="Description of Artificial Sequence: Synthetic oligonucleotide"
uuuugggaacaccgacaaaca

SEQ ID NO: 2254 - RNA, 21 nt, Artificial Sequence
  source: /note="Description of Artificial Sequence: Synthetic oligonucleotide"
gagcuucaggacauugcugua

SEQ ID NO: 2255 - RNA, 21 nt, Artificial Sequence
  source: /note="Description of Artificial Sequence: Synthetic oligonucleotide"
gcuucaggacauugcugugca

SEQ ID NO: 2256 - RNA, 21 nt, Artificial Sequence
  source: /note="Description of Artificial Sequence: Synthetic oligonucleotide"
cuucaggacauugcugugcua

SEQ ID NO: 2257 - RNA, 21 nt, Artificial Sequence
  source: /note="Description of Artificial Sequence: Synthetic oligonucleotide"
uucaggacauugcugugcuua

SEQ ID NO: 2258 - RNA, 21 nt, Artificial Sequence
  source: /note="Description of Artificial Sequence: Synthetic oligonucleotide"
ucaggacauugcugugcuuua

SEQ ID NO: 2259 - RNA, 21 nt, Artificial Sequence
  source: /note="Description of Artificial Sequence: Synthetic oligonucleotide"
caggacauugcugugcuuuga

SEQ ID NO: 2260 - RNA, 21 nt, Artificial Sequence
  source: /note="Description of Artificial Sequence: Synthetic oligonucleotide"
cgcuuacucucaccugcuuca

SEQ ID NO: 2261 - RNA, 21 nt, Artificial Sequence
  source: /note="Description of Artificial Sequence: Synthetic oligonucleotide"
gcuuacucucaccugcuucua

SEQ ID NO: 2262 - RNA, 21 nt, Artificial Sequence
  source: /note="Description of Artificial Sequence: Synthetic oligonucleotide"
uuacucucaccugcuucugaa

SEQ ID NO: 2263 - RNA, 21 nt, Artificial Sequence
  source: /note="Description of Artificial Sequence: Synthetic oligonucleotide"
cucucaccugcuucugaguua

SEQ ID NO: 2264 - RNA, 21 nt, Artificial Sequence
  source: /note="Description of Artificial Sequence: Synthetic oligonucleotide"
ucucaccugcuucugaguuga

SEQ ID NO: 2265 - RNA, 21 nt, Artificial Sequence
  source: /note="Description of Artificial Sequence: Synthetic oligonucleotide"
cucaccugcuucugaguugca

SEQ ID NO: 2266 - RNA, 21 nt, Artificial Sequence
  source: /note="Description of Artificial Sequence: Synthetic oligonucleotide"
ucaccugcuucugaguugcca

SEQ ID NO: 2267 - RNA, 21 nt, Artificial Sequence
  source: /note="Description of Artificial Sequence: Synthetic oligonucleotide"
caccugcuucugaguugccca

SEQ ID NO: 2268 - RNA, 21 nt, Artificial Sequence
  source: /note="Description of Artificial Sequence: Synthetic oligonucleotide"
accugcuucugaguugcccaa

SEQ ID NO: 2269 - RNA, 21 nt, Artificial Sequence
  source: /note="Description of Artificial Sequence: Synthetic oligonucleotide"
ccugcuucugaguugcccaga

SEQ ID NO: 2270 - RNA, 21 nt, Artificial Sequence
  source: /note="Description of Artificial Sequence: Synthetic oligonucleotide"
cggcgaagagaagagacacaa

SEQ ID NO: 2271 - RNA, 21 nt, Artificial Sequence
  source: /note="Description of Artificial Sequence: Synthetic oligonucleotide"
ggcgaagagaagagacacaua

SEQ ID NO: 2272 - RNA, 21 nt, Artificial Sequence
  source: /note="Description of Artificial Sequence: Synthetic oligonucleotide"
gcgaagagaagagacacauua

SEQ ID NO: 2273 - RNA, 21 nt, Artificial Sequence
  source: /note="Description of Artificial Sequence: Synthetic oligonucleotide"
cgaagagaagagacacauuga

SEQ ID NO: 2274 - RNA, 21 nt, Artificial Sequence
  source: /note="Description of Artificial Sequence: Synthetic oligonucleotide"
gaagagaagagacacauugua

SEQ ID NO: 2275 - RNA, 21 nt, Artificial Sequence
  source: /note="Description of Artificial Sequence: Synthetic oligonucleotide"
aagagaagagacacauuguua

SEQ ID NO: 2276 - RNA, 21 nt, Artificial Sequence
  source: /note="Description of Artificial Sequence: Synthetic oligonucleotide"
agagaagagacacauuguuga

SEQ ID NO: 2277 - RNA, 21 nt, Artificial Sequence
  source: /note="Description of Artificial Sequence: Synthetic oligonucleotide"
gagaagagacacauuguugga

SEQ ID NO: 2278 - RNA, 21 nt, Artificial Sequence
  source: /note="Description of Artificial Sequence: Synthetic oligonucleotide"
agaagagacacauuguuggaa

SEQ ID NO: 2279 - RNA, 21 nt, Artificial Sequence
  source: /note="Description of Artificial Sequence: Synthetic oligonucleotide"
gaagagacacauuguuggaaa

SEQ ID NO: 2280 - RNA, 21 nt, Artificial Sequence
  source: /note="Description of Artificial Sequence: Synthetic oligonucleotide"
aagagacacauuguuggaaga

SEQ ID NO: 2281 - RNA, 21 nt, Artificial Sequence
  source: /note="Description of Artificial Sequence: Synthetic oligonucleotide"
agagacacauuguuggaagaa

SEQ ID NO: 2282 - RNA, 21 nt, Artificial Sequence
  source: /note="Description of Artificial Sequence: Synthetic oligonucleotide"
gagacacauuguuggaagaaa

SEQ ID NO: 2283 - RNA, 21 nt, Artificial Sequence
  source: /note="Description of Artificial Sequence: Synthetic oligonucleotide"
agacacauuguuggaagaaga

SEQ ID NO: 2284 - RNA, 21 nt, Artificial Sequence
  source: /note="Description of Artificial Sequence: Synthetic oligonucleotide"
gacacauuguuggaagaagca

SEQ ID NO: 2285 - RNA, 21 nt, Artificial Sequence
  source: /note="Description of Artificial Sequence: Synthetic oligonucleotide"
acacauuguuggaagaagcaa

SEQ ID NO: 2286 - RNA, 21 nt, Artificial Sequence
  source: /note="Description of Artificial Sequence: Synthetic oligonucleotide"
cacauuguuggaagaagcaga

SEQ ID NO: 2287 - RNA, 21 nt, Artificial Sequence
  source: /note="Description of Artificial Sequence: Synthetic oligonucleotide"
uauguccucacaccauugaaa

SEQ ID NO: 2288 - RNA, 21 nt, Artificial Sequence
  source: /note="Description of Artificial Sequence: Synthetic oligonucleotide"
uccucacaccauugaaaccaa

SEQ ID NO: 2289 - RNA, 21 nt, Artificial Sequence
  source: /note="Description of Artificial Sequence: Synthetic oligonucleotide"
ccucacaccauugaaaccaca

SEQ ID NO: 2290 - RNA, 21 nt, Artificial Sequence
  source: /note="Description of Artificial Sequence: Synthetic oligonucleotide"
cucacaccauugaaaccacua

SEQ ID NO: 2291 - RNA, 21 nt, Artificial Sequence
  source: /note="Description of Artificial Sequence: Synthetic oligonucleotide"
ucacaccauugaaaccacuaa

SEQ ID NO: 2292 - RNA, 21 nt, Artificial Sequence
  source: /note="Description of Artificial Sequence: Synthetic oligonucleotide"
cacaccauugaaaccacuaga

SEQ ID NO: 2293 - RNA, 21 nt, Artificial Sequence
  source: /note="Description of Artificial Sequence: Synthetic oligonucleotide"
ccauugaaaccacuaguucua

SEQ ID NO: 2294 - RNA, 21 nt, Artificial Sequence
  source: /note="Description of Artificial Sequence: Synthetic oligonucleotide"
cauugaaaccacuaguucuga

SEQ ID NO: 2295 - RNA, 21 nt, Artificial Sequence
  source: /note="Description of Artificial Sequence: Synthetic oligonucleotide"
auugaaaccacuaguucugua

SEQ ID NO: 2296 - RNA, 21 nt, Artificial Sequence
  source: /note="Description of Artificial Sequence: Synthetic oligonucleotide"
uugaaaccacuaguucuguca

SEQ ID NO: 2297 - RNA, 21 nt, Artificial Sequence
  source: /note="Description of Artificial Sequence: Synthetic oligonucleotide"
ugaaaccacuaguucugucca

SEQ ID NO: 2298 - RNA, 21 nt, Artificial Sequence
  source: /note="Description of Artificial Sequence: Synthetic oligonucleotide"
gaccugguuguguguguguga

SEQ ID NO: 2299 - RNA, 21 nt, Artificial Sequence
  source: /note="Description of Artificial Sequence: Synthetic oligonucleotide"
accugguugugugugugugaa

SEQ ID NO: 2300 - RNA, 21 nt, Artificial Sequence
  source: /note="Description of Artificial Sequence: Synthetic oligonucleotide"
ccugguugugugugugugaga

SEQ ID NO: 2301 - RNA, 21 nt, Artificial Sequence
  source: /note="Description of Artificial Sequence: Synthetic oligonucleotide"
cugguugugugugugugagua

SEQ ID NO: 2302 - RNA, 21 nt, Artificial Sequence
  source: /note="Description of Artificial Sequence: Synthetic oligonucleotide"
ugguugugugugugugaguga

SEQ ID NO: 2303 - RNA, 21 nt, Artificial Sequence
  source: /note="Description of Artificial Sequence: Synthetic oligonucleotide"
gguugugugugugugagugga

SEQ ID NO: 2304 - RNA, 21 nt, Artificial Sequence
  source: /note="Description of Artificial Sequence: Synthetic oligonucleotide"
gugugugugugagugguugaa

SEQ ID NO: 2305 - RNA, 21 nt, Artificial Sequence
  source: /note="Description of Artificial Sequence: Synthetic oligonucleotide"
ugugugugugagugguugaca

SEQ ID NO: 2306 - RNA, 21 nt, Artificial Sequence
  source: /note="Description of Artificial Sequence: Synthetic oligonucleotide"
ugugugugagugguugaccua

SEQ ID NO: 2307 - RNA, 21 nt, Artificial Sequence
  source: /note="Description of Artificial Sequence: Synthetic oligonucleotide"
ugugugagugguugaccuuca

SEQ ID NO: 2308 - RNA, 21 nt, Artificial Sequence
  source: /note="Description of Artificial Sequence: Synthetic oligonucleotide"
gugugagugguugaccuucca

SEQ ID NO: 2309 - RNA, 21 nt, Artificial Sequence
  source: /note="Description of Artificial Sequence: Synthetic oligonucleotide"
ugugagugguugaccuuccua

SEQ ID NO: 2310 - RNA, 21 nt, Artificial Sequence
  source: /note="Description of Artificial Sequence: Synthetic oligonucleotide"
ugagugguugaccuuccucca

SEQ ID NO: 2311 - RNA, 21 nt, Artificial Sequence
  source: /note="Description of Artificial Sequence: Synthetic oligonucleotide"
gugguugaccuuccuccauca

SEQ ID NO: 2312 - RNA, 21 nt, Artificial Sequence
  source: /note="Description of Artificial Sequence: Synthetic oligonucleotide"
uuguggaggcagagaaaagaa

SEQ ID NO: 2313 - RNA, 21 nt, Artificial Sequence
  source: /note="Description of Artificial Sequence: Synthetic oligonucleotide"
uguggaggcagagaaaagaga

SEQ ID NO: 2314 - RNA, 21 nt, Artificial Sequence
  source: /note="Description of Artificial Sequence: Synthetic oligonucleotide"
guggaggcagagaaaagagaa

SEQ ID NO: 2315 - RNA, 21 nt, Artificial Sequence
  source: /note="Description of Artificial Sequence: Synthetic oligonucleotide"
uggaggcagagaaaagagaaa

SEQ ID NO: 2316 - RNA, 21 nt, Artificial Sequence
  source: /note="Description of Artificial Sequence: Synthetic oligonucleotide"
ggaggcagagaaaagagaaaa

SEQ ID NO: 2317 - RNA, 21 nt, Artificial Sequence
  source: /note="Description of Artificial Sequence: Synthetic oligonucleotide"
gaggcagagaaaagagaaaga

SEQ ID NO: 2318 - RNA, 21 nt, Artificial Sequence
  source: /note="Description of Artificial Sequence: Synthetic oligonucleotide"
aggcagagaaaagagaaagua

SEQ ID NO: 2319 - RNA, 21 nt, Artificial Sequence
  source: /note="Description of Artificial Sequence: Synthetic oligonucleotide"
ggcagagaaaagagaaaguga

SEQ ID NO: 2320 - RNA, 21 nt, Artificial Sequence
  source: /note="Description of Artificial Sequence: Synthetic oligonucleotide"
gcagagaaaagagaaagugua

SEQ ID NO: 2321 - RNA, 21 nt, Artificial Sequence
  source: /note="Description of Artificial Sequence: Synthetic oligonucleotide"
cagagaaaagagaaaguguua

SEQ ID NO: 2322 - RNA, 21 nt, Artificial Sequence
  source: /note="Description of Artificial Sequence: Synthetic oligonucleotide"
agagaaaagagaaaguguuua

SEQ ID NO: 2323 - RNA, 21 nt, Artificial Sequence
  source: /note="Description of Artificial Sequence: Synthetic oligonucleotide"
gagaaaagagaaaguguuuua

SEQ ID NO: 2324 - RNA, 21 nt, Artificial Sequence
  source: /note="Description of Artificial Sequence: Synthetic oligonucleotide"
agaaaagagaaaguguuuuaa

SEQ ID NO: 2325 - RNA, 21 nt, Artificial Sequence
  source: /note="Description of Artificial Sequence: Synthetic oligonucleotide"
gaaaagagaaaguguuuuaua

SEQ ID NO: 2326 - RNA, 21 nt, Artificial Sequence
  source: /note="Description of Artificial Sequence: Synthetic oligonucleotide"
aaaagagaaaguguuuuauaa

SEQ ID NO: 2327 - RNA, 21 nt, Artificial Sequence
  source: /note="Description of Artificial Sequence: Synthetic oligonucleotide"
aaagagaaaguguuuuauaua

SEQ ID NO: 2328 - RNA, 21 nt, Artificial Sequence
  source: /note="Description of Artificial Sequence: Synthetic oligonucleotide"
aagagaaaguguuuuauauaa

SEQ ID NO: 2329 - RNA, 21 nt, Artificial Sequence
  source: /note="Description of Artificial Sequence: Synthetic oligonucleotide"
agagaaaguguuuuauauaca

SEQ ID NO: 2330 - RNA, 21 nt, Artificial Sequence
  source: /note="Description of Artificial Sequence: Synthetic oligonucleotide"
gagaaaguguuuuauauacga

SEQ ID NO: 2331 - RNA, 21 nt, Artificial Sequence
  source: /note="Description of Artificial Sequence: Synthetic oligonucleotide"
agaaaguguuuuauauacgga

SEQ ID NO: 2332 - RNA, 21 nt, Artificial Sequence
  source: /note="Description of Artificial Sequence: Synthetic oligonucleotide"
aaaguguuuuauauacgguaa

SEQ ID NO: 2333 - RNA, 21 nt, Artificial Sequence
  source: /note="Description of Artificial Sequence: Synthetic oligonucleotide"
aaguguuuuauauacgguaca

SEQ ID NO: 2334 - RNA, 21 nt, Artificial Sequence
  source: /note="Description of Artificial Sequence: Synthetic oligonucleotide"
aguguuuuauauacgguacua

SEQ ID NO: 2335 - RNA, 21 nt, Artificial Sequence
  source: /note="Description of Artificial Sequence: Synthetic oligonucleotide"
guguuuuauauacgguacuua

SEQ ID NO: 2336 - RNA, 21 nt, Artificial Sequence
  source: /note="Description of Artificial Sequence: Synthetic oligonucleotide"
uguuuuauauacgguacuuaa

SEQ ID NO: 2337 - RNA, 21 nt, Artificial Sequence
  source: /note="Description of Artificial Sequence: Synthetic oligonucleotide"
guuuuauauacgguacuuaua

SEQ ID NO: 2338 - RNA, 21 nt, Artificial Sequence
  source: /note="Description of Artificial Sequence: Synthetic oligonucleotide"
uuuuauauacgguacuuauua

SEQ ID NO: 2339 - RNA, 21 nt, Artificial Sequence
  source: /note="Description of Artificial Sequence: Synthetic oligonucleotide"
uuuauauacgguacuuauuua

SEQ ID NO: 2340 - RNA, 21 nt, Artificial Sequence
  source: /note="Description of Artificial Sequence: Synthetic oligonucleotide"
uuauauacgguacuuauuuaa

SEQ ID NO: 2341 - RNA, 21 nt, Artificial Sequence
  source: /note="Description of Artificial Sequence: Synthetic oligonucleotide"
uauauacgguacuuauuuaaa

SEQ ID NO: 2342 - RNA, 21 nt, Artificial Sequence
  source: /note="Description of Artificial Sequence: Synthetic oligonucleotide"
guacuuauuuaauaucccuua

SEQ ID NO: 2343 - RNA, 21 nt, Artificial Sequence
  source: /note="Description of Artificial Sequence: Synthetic oligonucleotide"
uacuuauuuaauaucccuuua

SEQ ID NO: 2344 - RNA, 21 nt, Artificial Sequence
  source: /note="Description of Artificial Sequence: Synthetic oligonucleotide"
uuaugagauguaucuuuugca

SEQ ID NO: 2345 - RNA, 21 nt, Artificial Sequence
  source: /note="Description of Artificial Sequence: Synthetic oligonucleotide"
uaugagauguaucuuuugcua

SEQ ID NO: 2346 - RNA, 21 nt, Artificial Sequence
  source: /note="Description of Artificial Sequence: Synthetic oligonucleotide"
augagauguaucuuuugcuca

SEQ ID NO: 2347 - RNA, 21 nt, Artificial Sequence
  source: /note="Description of Artificial Sequence: Synthetic oligonucleotide"
ugagauguaucuuuugcucua

SEQ ID NO: 2348 - RNA, 21 nt, Artificial Sequence
  source: /note="Description of Artificial Sequence: Synthetic oligonucleotide"
gagauguaucuuuugcucuca

SEQ ID NO: 2349 - RNA, 21 nt, Artificial Sequence
  source: /note="Description of Artificial Sequence: Synthetic oligonucleotide"
agauguaucuuuugcucucua

SEQ ID NO: 2350 - RNA, 21 nt, Artificial Sequence
  source: /note="Description of Artificial Sequence: Synthetic oligonucleotide"
gauguaucuuuugcucucuca

SEQ ID NO: 2351 - RNA, 21 nt, Artificial Sequence
  source: /note="Description of Artificial Sequence: Synthetic oligonucleotide"
auguaucuuuugcucucucua

SEQ ID NO: 2352 - RNA, 21 nt, Artificial Sequence
  source: /note="Description of Artificial Sequence: Synthetic oligonucleotide"
gcucucucuugcucucuuaua

SEQ ID NO: 2353 - RNA, 21 nt, Artificial Sequence
  source: /note="Description of Artificial Sequence: Synthetic oligonucleotide"
cucucucuugcucucuuauua

SEQ ID NO: 2354 - RNA, 21 nt, Artificial Sequence
  source: /note="Description of Artificial Sequence: Synthetic oligonucleotide"
ucucucuugcucucuuauuua

SEQ ID NO: 2355 - RNA, 21 nt, Artificial Sequence
  source: /note="Description of Artificial Sequence: Synthetic oligonucleotide"
cucucuugcucucuuauuuga

SEQ ID NO: 2356 - RNA, 21 nt, Artificial Sequence
  source: /note="Description of Artificial Sequence: Synthetic oligonucleotide"
ucucuugcucucuuauuugua

SEQ ID NO: 2357 - RNA, 21 nt, Artificial Sequence
  source: /note="Description of Artificial Sequence: Synthetic oligonucleotide"
cucuugcucucuuauuuguaa

SEQ ID NO: 2358 - RNA, 21 nt, Artificial Sequence
  source: /note="Description of Artificial Sequence: Synthetic oligonucleotide"
ucuugcucucuuauuuguaca

SEQ ID NO: 2359 - RNA, 21 nt, Artificial Sequence
  source: /note="Description of Artificial Sequence: Synthetic oligonucleotide"
cuugcucucuuauuuguacca

SEQ ID NO: 2360 - RNA, 21 nt, Artificial Sequence
  source: /note="Description of Artificial Sequence: Synthetic oligonucleotide"
uugcucucuuauuuguaccga

SEQ ID NO: 2361 - RNA, 21 nt, Artificial Sequence
  source: /note="Description of Artificial Sequence: Synthetic oligonucleotide"
ugcucucuuauuuguaccgga

SEQ ID NO: 2362 - RNA, 21 nt, Artificial Sequence
  source: /note="Description of Artificial Sequence: Synthetic oligonucleotide"
cucucuuauuuguaccgguua

SEQ ID NO: 2363 - RNA, 21 nt, Artificial Sequence
  source: /note="Description of Artificial Sequence: Synthetic oligonucleotide"
ucucuuauuuguaccgguuua

SEQ ID NO: 2364 - RNA, 21 nt, Artificial Sequence
  source: /note="Description of Artificial Sequence: Synthetic oligonucleotide"
cucuuauuuguaccgguuuua

SEQ ID NO: 2365 - RNA, 21 nt, Artificial Sequence
  source: /note="Description of Artificial Sequence: Synthetic oligonucleotide"
ucuuauuuguaccgguuuuua

SEQ ID NO: 2366 - RNA, 21 nt, Artificial Sequence
  source: /note="Description of Artificial Sequence: Synthetic oligonucleotide"
cuuauuuguaccgguuuuuga

SEQ ID NO: 2367 - RNA, 21 nt, Artificial Sequence
  source: /note="Description of Artificial Sequence: Synthetic oligonucleotide"
uuauuuguaccgguuuuugua

SEQ ID NO: 2368 - RNA, 21 nt, Artificial Sequence
  source: /note="Description of Artificial Sequence: Synthetic oligonucleotide"
uauuuguaccgguuuuuguaa

SEQ ID NO: 2369 - RNA, 21 nt, Artificial Sequence
  source: /note="Description of Artificial Sequence: Synthetic oligonucleotide"
auuuguaccgguuuuuguaua

SEQ ID NO: 2370 - RNA, 21 nt, Artificial Sequence
  source: /note="Description of Artificial Sequence: Synthetic oligonucleotide"
uuuguaccgguuuuuguauaa

SEQ ID NO: 2371 - RNA, 21 nt, Artificial Sequence
  source: /note="Description of Artificial Sequence: Synthetic oligonucleotide"
uuguaccgguuuuuguauaua

SEQ ID NO: 2372 - RNA, 21 nt, Artificial Sequence
  source: /note="Description of Artificial Sequence: Synthetic oligonucleotide"
uguaccgguuuuuguauauaa

SEQ ID NO: 2373 - RNA, 21 nt, Artificial Sequence
  source: /note="Description of Artificial Sequence: Synthetic oligonucleotide"
guaccgguuuuuguauauaaa

SEQ ID NO: 2374 - RNA, 21 nt, Artificial Sequence
  source: /note="Description of Artificial Sequence: Synthetic oligonucleotide"
uaccgguuuuuguauauaaaa

SEQ ID NO: 2375 - RNA, 21 nt, Artificial Sequence
  source: /note="Description of Artificial Sequence: Synthetic oligonucleotide"
accgguuuuuguauauaaaaa

SEQ ID NO: 2376 - RNA, 21 nt, Artificial Sequence
  source: /note="Description of Artificial Sequence: Synthetic oligonucleotide"
auucauguuuccaaucucuca

SEQ ID NO: 2377 - RNA, 21 nt, Artificial Sequence
  source: /note="Description of Artificial Sequence: Synthetic oligonucleotide"
uucauguuuccaaucucucua

SEQ ID NO: 2378 - RNA, 21 nt, Artificial Sequence
  source: /note="Description of Artificial Sequence: Synthetic oligonucleotide"
ucauguuuccaaucucucuca

SEQ ID NO: 2379 - RNA, 21 nt, Artificial Sequence
  source: /note="Description of Artificial Sequence: Synthetic oligonucleotide"
cauguuuccaaucucucucua

SEQ ID NO: 2380 - RNA, 21 nt, Artificial Sequence
  source: /note="Description of Artificial Sequence: Synthetic oligonucleotide"
auguuuccaaucucucucuca

SEQ ID NO: 2381 - RNA, 21 nt, Artificial Sequence
  source: /note="Description of Artificial Sequence: Synthetic oligonucleotide"
uguuuccaaucucucucucca

SEQ ID NO: 2382 - RNA, 21 nt, Artificial Sequence
  source: /note="Description of Artificial Sequence: Synthetic oligonucleotide"
uuuccaaucucucucucccua

SEQ ID NO: 2383 - RNA, 21 nt, Artificial Sequence
  source: /note="Description of Artificial Sequence: Synthetic oligonucleotide"
uccaaucucucucucccugaa

SEQ ID NO: 2384 - RNA, 21 nt, Artificial Sequence
  source: /note="Description of Artificial Sequence: Synthetic oligonucleotide"
cggugacagucacuagcuuaa

SEQ ID NO: 2385 - RNA, 21 nt, Artificial Sequence
  source: /note="Description of Artificial Sequence: Synthetic oligonucleotide"
ggugacagucacuagcuuaua

SEQ ID NO: 2386 - RNA, 21 nt, Artificial Sequence
  source: /note="Description of Artificial Sequence: Synthetic oligonucleotide"
agucacuagcuuaucuugaaa

SEQ ID NO: 2387 - RNA, 21 nt, Artificial Sequence
  source: /note="Description of Artificial Sequence: Synthetic oligonucleotide"
gucacuagcuuaucuugaaca

SEQ ID NO: 2388 - RNA, 21 nt, Artificial Sequence
  source: /note="Description of Artificial Sequence: Synthetic oligonucleotide"
ucacuagcuuaucuugaacaa

SEQ ID NO: 2389 - RNA, 21 nt, Artificial Sequence
  source: /note="Description of Artificial Sequence: Synthetic oligonucleotide"
acuagcuuaucuugaacagaa

SEQ ID NO: 2390 - RNA, 21 nt, Artificial Sequence
  source: /note="Description of Artificial Sequence: Synthetic oligonucleotide"
cuagcuuaucuugaacagaua

SEQ ID NO: 2391 - RNA, 21 nt, Artificial Sequence
  source: /note="Description of Artificial Sequence: Synthetic oligonucleotide"
uagcuuaucuugaacagauaa

SEQ ID NO: 2392 - RNA, 21 nt, Artificial Sequence
  source: /note="Description of Artificial Sequence: Synthetic oligonucleotide"
agcuuaucuugaacagauaua

SEQ ID NO: 2393 - RNA, 21 nt, Artificial Sequence
  source: /note="Description of Artificial Sequence: Synthetic oligonucleotide"
gcuuaucuugaacagauauua

SEQ ID NO: 2394 - RNA, 21 nt, Artificial Sequence
  source: /note="Description of Artificial Sequence: Synthetic oligonucleotide"
cagcacacauuccuuugaaaa

SEQ ID NO: 2395 - RNA, 21 nt, Artificial Sequence
  source: /note="Description of Artificial Sequence: Synthetic oligonucleotide"
agcacacauuccuuugaaaua

SEQ ID NO: 2396 - RNA, 21 nt, Artificial Sequence
  source: /note="Description of Artificial Sequence: Synthetic oligonucleotide"
gcacacauuccuuugaaauaa

SEQ ID NO: 2397 - RNA, 21 nt, Artificial Sequence
  source: /note="Description of Artificial Sequence: Synthetic oligonucleotide"
cacacauuccuuugaaauaaa

SEQ ID NO: 2398 - RNA, 21 nt, Artificial Sequence
  source: /note="Description of Artificial Sequence: Synthetic oligonucleotide"
cacauuccuuugaaauaagga

SEQ ID NO: 2399 - RNA, 21 nt, Artificial Sequence
  source: /note="Description of Artificial Sequence: Synthetic oligonucleotide"
uccuuugaaauaagguuucaa

SEQ ID NO: 2400 - RNA, 21 nt, Artificial Sequence
  source: /note="Description of Artificial Sequence: Synthetic oligonucleotide"
cuuugaaauaagguuucaaua

SEQ ID NO: 2401 - RNA, 21 nt, Artificial Sequence
  source: /note="Description of Artificial Sequence: Synthetic oligonucleotide"
uuugaaauaagguuucaauaa

SEQ ID NO: 2402 - RNA, 21 nt, Artificial Sequence
  source: /note="Description of Artificial Sequence: Synthetic oligonucleotide"
agguuucaauauacaucuaca

SEQ ID NO: 2403 - RNA, 21 nt, Artificial Sequence
  source: /note="Description of Artificial Sequence: Synthetic oligonucleotide"
gguuucaauauacaucuacaa

SEQ ID NO: 2404 - RNA, 21 nt, Artificial Sequence
  source: /note="Description of Artificial Sequence: Synthetic oligonucleotide"
guuucaauauacaucuacaua

SEQ ID NO: 2405 - RNA, 21 nt, Artificial Sequence
  source: /note="Description of Artificial Sequence: Synthetic oligonucleotide"
uuucaauauacaucuacauaa

SEQ ID NO: 2406 - RNA, 21 nt, Artificial Sequence
  source: /note="Description of Artificial Sequence: Synthetic oligonucleotide"
uucaauauacaucuacauaca

SEQ ID NO: 2407 - RNA, 21 nt, Artificial Sequence
  source: /note="Description of Artificial Sequence: Synthetic oligonucleotide"
uauuuggcaacuuguauuuga

SEQ ID NO: 2408 - RNA, 21 nt, Artificial Sequence
  source: /note="Description of Artificial Sequence: Synthetic oligonucleotide"
uuuggcaacuuguauuuguga

SEQ ID NO: 2409 - RNA, 21 nt, Artificial Sequence
  source: /note="Description of Artificial Sequence: Synthetic oligonucleotide"
uggcaacuuguauuuguguga

SEQ ID NO: 2410 - RNA, 21 nt, Artificial Sequence
  source: /note="Description of Artificial Sequence: Synthetic oligonucleotide"
ggcaacuuguauuugugugua

SEQ ID NO: 2411 - RNA, 21 nt, Artificial Sequence
  source: /note="Description of Artificial Sequence: Synthetic oligonucleotide"
gcaacuuguauuuguguguaa

SEQ ID NO: 2412 - RNA, 21 nt, Artificial Sequence
  source: /note="Description of Artificial Sequence: Synthetic oligonucleotide"
caacuuguauuuguguguaua

SEQ ID NO: 2413 - RNA, 21 nt, Artificial Sequence
  source: /note="Description of Artificial Sequence: Synthetic oligonucleotide"
aacuuguauuuguguguauaa

SEQ ID NO: 2414 - RNA, 21 nt, Artificial Sequence
  source: /note="Description of Artificial Sequence: Synthetic oligonucleotide"
acuuguauuuguguguauaua

SEQ ID NO: 2415 - RNA, 21 nt, Artificial Sequence
  source: /note="Description of Artificial Sequence: Synthetic oligonucleotide"
uucugauaaaauagacauuga

SEQ ID NO: 2416 - RNA, 21 nt, Artificial Sequence
  source: /note="Description of Artificial Sequence: Synthetic oligonucleotide"
ugauaaaauagacauugcuaa

SEQ ID NO: 2417 - RNA, 21 nt, Artificial Sequence
  source: /note="Description of Artificial Sequence: Synthetic oligonucleotide"
gauaaaauagacauugcuaua

SEQ ID NO: 2418 - RNA, 21 nt, Artificial Sequence
  source: /note="Description of Artificial Sequence: Synthetic oligonucleotide"
uaaaauagacauugcuauuca

SEQ ID NO: 2419 - RNA, 21 nt, Artificial Sequence
  source: /note="Description of Artificial Sequence: Synthetic oligonucleotide"
uagacauugcuauucuguuua

SEQ ID NO: 2420 - RNA, 21 nt, Artificial Sequence
  source: /note="Description of Artificial Sequence: Synthetic oligonucleotide"
agacauugcuauucuguuuua

SEQ ID NO: 2421 - RNA, 21 nt, Artificial Sequence
  source: /note="Description of Artificial Sequence: Synthetic oligonucleotide"
ucuacauacuaaaucucucua

SEQ ID NO: 2422 - RNA, 21 nt, Artificial Sequence
  source: /note="Description of Artificial Sequence: Synthetic oligonucleotide"
cuacauacuaaaucucucuca

SEQ ID NO: 2423 - RNA, 21 nt, Artificial Sequence
  source: /note="Description of Artificial Sequence: Synthetic oligonucleotide"
uacauacuaaaucucucucca

SEQ ID NO: 2424 - RNA, 21 nt, Artificial Sequence
  source: /note="Description of Artificial Sequence: Synthetic oligonucleotide"
acauacuaaaucucucuccua

SEQ ID NO: 2425 - RNA, 21 nt, Artificial Sequence
  source: /note="Description of Artificial Sequence: Synthetic oligonucleotide"
cauacuaaaucucucuccuua

SEQ ID NO: 2426 - RNA, 21 nt, Artificial Sequence
  source: /note="Description of Artificial Sequence: Synthetic oligonucleotide"
auacuaaaucucucuccuuua

SEQ ID NO: 2427 - RNA, 21 nt, Artificial Sequence
  source: /note="Description of Artificial Sequence: Synthetic oligonucleotide"
uacuaaaucucucuccuuuua

SEQ ID NO: 2428 - RNA, 21 nt, Artificial Sequence
  source: /note="Description of Artificial Sequence: Synthetic oligonucleotide"
cauuuauuuauuggugcuaca

SEQ ID NO: 2429 - RNA, 21 nt, Artificial Sequence
  source: /note="Description of Artificial Sequence: Synthetic oligonucleotide"
auuuauuuauuggugcuacua

SEQ ID NO: 2430 - RNA, 21 nt, Artificial Sequence
  source: /note="Description of Artificial Sequence: Synthetic oligonucleotide"
uuuauuuauuggugcuacuga

SEQ ID NO: 2431 - RNA, 21 nt, Artificial Sequence
  source: /note="Description of Artificial Sequence: Synthetic oligonucleotide"
uuauuuauuggugcuacugua

SEQ ID NO: 2432 - RNA, 21 nt, Artificial Sequence
  source: /note="Description of Artificial Sequence: Synthetic oligonucleotide"
uauuuauuggugcuacuguua

SEQ ID NO: 2433 - RNA, 21 nt, Artificial Sequence
  source: /note="Description of Artificial Sequence: Synthetic oligonucleotide"
auuuauuggugcuacuguuua

SEQ ID NO: 2434 - RNA, 21 nt, Artificial Sequence
  source: /note="Description of Artificial Sequence: Synthetic oligonucleotide"
uuauuggugcuacuguuuaua

SEQ ID NO: 2435 - RNA, 21 nt, Artificial Sequence
  source: /note="Description of Artificial Sequence: Synthetic oligonucleotide"
auuggugcuacuguuuaucca

SEQ ID NO: 2436 - RNA, 21 nt, Artificial Sequence
  source: /note="Description of Artificial Sequence: Synthetic oligonucleotide"
gaaaagauauuaacaucacga

SEQ ID NO: 2437 - RNA, 21 nt, Artificial Sequence
  source: /note="Description of Artificial Sequence: Synthetic oligonucleotide"
aacaucacgucuuugucucua

SEQ ID NO: 2438 - RNA, 21 nt, Artificial Sequence
  source: /note="Description of Artificial Sequence: Synthetic oligonucleotide"
acaucacgucuuugucucuaa

SEQ ID NO: 2439 - RNA, 21 nt, Artificial Sequence
  source: /note="Description of Artificial Sequence: Synthetic oligonucleotide"
gucuuugucucuagugcagua

SEQ ID NO: 2440 - RNA, 21 nt, Artificial Sequence
  source: /note="Description of Artificial Sequence: Synthetic oligonucleotide"
ucuuugucucuagugcaguua

SEQ ID NO: 2441 - RNA, 21 nt, Artificial Sequence
  source: /note="Description of Artificial Sequence: Synthetic oligonucleotide"
cuuugucucuagugcaguuua

SEQ ID NO: 2442 - RNA, 21 nt, Artificial Sequence
  source: /note="Description of Artificial Sequence: Synthetic oligonucleotide"
gagauauuccguaguacauaa

SEQ ID NO: 2443 - RNA, 21 nt, Artificial Sequence
  source: /note="Description of Artificial Sequence: Synthetic oligonucleotide"
agauauuccguaguacauaua

SEQ ID NO: 2444 - RNA, 21 nt, Artificial Sequence
  source: /note="Description of Artificial Sequence: Synthetic oligonucleotide"
gauauuccguaguacauauua

SEQ ID NO: 2445 - RNA, 21 nt, Artificial Sequence
  source: /note="Description of Artificial Sequence: Synthetic oligonucleotide"
cgacaaagaaauacagauaua

SEQ ID NO: 2446 - RNA, 21 nt, Artificial Sequence
  source: /note="Description of Artificial Sequence: Synthetic oligonucleotide"
gacaaagaaauacagauauaa

SEQ ID NO: 2447 - RNA, 21 nt, Artificial Sequence
  source: /note="Description of Artificial Sequence: Synthetic oligonucleotide"
acaaagaaauacagauauaua

SEQ ID NO: 2448 - RNA, 21 nt, Artificial Sequence
  source: /note="Description of Artificial Sequence: Synthetic oligonucleotide"
caaagaaauacagauauauca

SEQ ID NO: 2449 - RNA, 23 nt, Artificial Sequence
  source: /note="Description of Artificial Sequence: Synthetic oligonucleotide"
uaauaucaaauuccagcaccgag

SEQ ID NO: 2450 - RNA, 23 nt, Artificial Sequence
  source: /note="Description of Artificial Sequence: Synthetic oligonucleotide"
ugaauaucaaauuccagcaccga

SEQ ID NO: 2451 - RNA, 23 nt, Artificial Sequence
  source: /note="Description of Artificial Sequence: Synthetic oligonucleotide"
uaugaauaucaaauuccagcacc

SEQ ID NO: 2452 - RNA, 23 nt, Artificial Sequence
  source: /note="Description of Artificial Sequence: Synthetic oligonucleotide"
uaaugaauaucaaauuccagcac

SEQ ID NO: 2453 - RNA, 23 nt, Artificial Sequence
  source: /note="Description of Artificial Sequence: Synthetic oligonucleotide"
uucaaugaauaucaaauuccagc

SEQ ID NO: 2454 - RNA, 23 nt, Artificial Sequence
  source: /note="Description of Artificial Sequence: Synthetic oligonucleotide"
uaucaaugaauaucaaauuccag

SEQ ID NO: 2455 - RNA, 23 nt, Artificial Sequence
  source: /note="Description of Artificial Sequence: Synthetic oligonucleotide"
ugaucaaugaauaucaaauucca

SEQ ID NO: 2456 - RNA, 23 nt, Artificial Sequence
  source: /note="Description of Artificial Sequence: Synthetic oligonucleotide"
uggaucaaugaauaucaaauucc

SEQ ID NO: 2457 - RNA, 23 nt, Artificial Sequence
  source: /note="Description of Artificial Sequence: Synthetic oligonucleotide"
ucggaucaaugaauaucaaauuc

SEQ ID NO: 2458 - RNA, 23 nt, Artificial Sequence
  source: /note="Description of Artificial Sequence: Synthetic oligonucleotide"
uccggaucaaugaauaucaaauu

SEQ ID NO: 2459 - RNA, 23 nt, Artificial Sequence
  source: /note="Description of Artificial Sequence: Synthetic oligonucleotide"
ugaauggcaagcaaaaauaaauu

SEQ ID NO: 2460 - RNA, 23 nt, Artificial Sequence
  source: /note="Description of Artificial Sequence: Synthetic oligonucleotide"
uggaauggcaagcaaaaauaaau

SEQ ID NO: 2461 - RNA, 23 nt, Artificial Sequence
  source: /note="Description of Artificial Sequence: Synthetic oligonucleotide"
uccaaaauccacagugauuuggg

SEQ ID NO: 2462 - RNA, 23 nt, Artificial Sequence
  source: /note="Description of Artificial Sequence: Synthetic oligonucleotide"
uuccaaaauccacagugauuugg

SEQ ID NO: 2463 - RNA, 23 nt, Artificial Sequence
  source: /note="Description of Artificial Sequence: Synthetic oligonucleotide"
uuuccaaaauccacagugauuug

SEQ ID NO: 2464 - RNA, 23 nt, Artificial Sequence
  source: /note="Description of Artificial Sequence: Synthetic oligonucleotide"
uuuuccaaaauccacagugauuu

SEQ ID NO: 2465 - RNA, 23 nt, Artificial Sequence
  source: /note="Description of Artificial Sequence: Synthetic oligonucleotide"
uguuuccaaaauccacagugauu

SEQ ID NO: 2466 - RNA, 23 nt, Artificial Sequence
  source: /note="Description of Artificial Sequence: Synthetic oligonucleotide"
ugguuuccaaaauccacagugau

SEQ ID NO: 2467 - RNA, 23 nt, Artificial Sequence
  source: /note="Description of Artificial Sequence: Synthetic oligonucleotide"
uugguuuccaaaauccacaguga

SEQ ID NO: 2468 - RNA, 23 nt, Artificial Sequence
  source: /note="Description of Artificial Sequence: Synthetic oligonucleotide"
ucugguuuccaaaauccacagug

SEQ ID NO: 2469 - RNA, 23 nt, Artificial Sequence
  source: /note="Description of Artificial Sequence: Synthetic oligonucleotide"
ugcugguuuccaaaauccacagu

SEQ ID NO: 2470 - RNA, 23 nt, Artificial Sequence
  source: /note="Description of Artificial Sequence: Synthetic oligonucleotide"
uugcugguuuccaaaauccacag

SEQ ID NO: 2471 - RNA, 23 nt, Artificial Sequence
  source: /note="Description of Artificial Sequence: Synthetic oligonucleotide"
uuucugcugguuuccaaaaucca

SEQ ID NO: 2472 - RNA, 23 nt, Artificial Sequence
  source: /note="Description of Artificial Sequence: Synthetic oligonucleotide"
uuuucugcugguuuccaaaaucc

SEQ ID NO: 2473 - RNA, 23 nt, Artificial Sequence
  source: /note="Description of Artificial Sequence: Synthetic oligonucleotide"
ucuuucugcugguuuccaaaauc

SEQ ID NO: 2474 - RNA, 23 nt, Artificial Sequence
  source: /note="Description of Artificial Sequence: Synthetic oligonucleotide"
uucuuucugcugguuuccaaaau

SEQ ID NO: 2475 - RNA, 23 nt, Artificial Sequence
  source: /note="Description of Artificial Sequence: Synthetic oligonucleotide"
uuccucuuucugcugguuuccaa

SEQ ID NO: 2476 - RNA, 23 nt, Artificial Sequence
  source: /note="Description of Artificial Sequence: Synthetic oligonucleotide"
uuuuccucuuucugcugguuucc

SEQ ID NO: 2477 - RNA, 23 nt, Artificial Sequence
  source: /note="Description of Artificial Sequence: Synthetic oligonucleotide"
ucuuuccucuuucugcugguuuc

SEQ ID NO: 2478 - RNA, 23 nt, Artificial Sequence
  source: /note="Description of Artificial Sequence: Synthetic oligonucleotide"
uucuuuccucuuucugcugguuu

SEQ ID NO: 2479 - RNA, 23 nt, Artificial Sequence
  source: /note="Description of Artificial Sequence: Synthetic oligonucleotide"
ucucuuuccucuuucugcugguu

SEQ ID NO: 2480 - RNA, 23 nt, Artificial Sequence
  source: /note="Description of Artificial Sequence: Synthetic oligonucleotide"
uccucuuuccucuuucugcuggu

SEQ ID NO: 2481 - RNA, 23 nt, Artificial Sequence
  source: /note="Description of Artificial Sequence: Synthetic oligonucleotide"
uaccucuuuccucuuucugcugg

SEQ ID NO: 2482 - RNA, 23 nt, Artificial Sequence
  source: /note="Description of Artificial Sequence: Synthetic oligonucleotide"
uuaccucuuuccucuuucugcug

SEQ ID NO: 2483 - RNA, 23 nt, Artificial Sequence
  source: /note="Description of Artificial Sequence: Synthetic oligonucleotide"
ucuaccucuuuccucuuucugcu

SEQ ID NO: 2484 - RNA, 23 nt, Artificial Sequence
  source: /note="Description of Artificial Sequence: Synthetic oligonucleotide"
uuugcuaccucuuuccucuuucu

SEQ ID NO: 2485 - RNA, 23 nt, Artificial Sequence
  source: /note="Description of Artificial Sequence: Synthetic oligonucleotide"
ucuugcuaccucuuuccucuuuc

SEQ ID NO: 2486 - RNA, 23 nt, Artificial Sequence
  source: /note="Description of Artificial Sequence: Synthetic oligonucleotide"
uucuugcuaccucuuuccucuuu

SEQ ID NO: 2487 - RNA, 23 nt, Artificial Sequence
  source: /note="Description of Artificial Sequence: Synthetic oligonucleotide"
ucucuugcuaccucuuuccucuu

SEQ ID NO: 2488 - RNA, 23 nt, Artificial Sequence
  source: /note="Description of Artificial Sequence: Synthetic oligonucleotide"
uagcucuugcuaccucuuuccuc

SEQ ID NO: 2489 - RNA, 23 nt, Artificial Sequence
  source: /note="Description of Artificial Sequence: Synthetic oligonucleotide"
ucucuggagcucuugcuaccucu

SEQ ID NO: 2490 - RNA, 23 nt, Artificial Sequence
  source: /note="Description of Artificial Sequence: Synthetic oligonucleotide"
uuuccucgacuucucucuggagc

SEQ ID NO: 2491 - RNA, 23 nt, Artificial Sequence
  source: /note="Description of Artificial Sequence: Synthetic oligonucleotide"
ucuuccucgacuucucucuggag

SEQ ID NO: 2492 - RNA, 23 nt, Artificial Sequence
  source: /note="Description of Artificial Sequence: Synthetic oligonucleotide"
uucuuccucgacuucucucugga

SEQ ID NO: 2493 - RNA, 23 nt, Artificial Sequence
  source: /note="Description of Artificial Sequence: Synthetic oligonucleotide"
ucucucuuccucgacuucucucu

SEQ ID NO: 2494 - RNA, 23 nt, Artificial Sequence
  source: /note="Description of Artificial Sequence: Synthetic oligonucleotide"
uucucucuuccucgacuucucuc

SEQ ID NO: 2495 - RNA, 23 nt, Artificial Sequence
  source: /note="Description of Artificial Sequence: Synthetic oligonucleotide"
uucucucucuuccucgacuucuc

SEQ ID NO: 2496 - RNA, 23 nt, Artificial Sequence
  source: /note="Description of Artificial Sequence: Synthetic oligonucleotide"
uccaaaagcaggucacucacuuu

SEQ ID NO: 2497 - RNA, 23 nt, Artificial Sequence
  source: /note="Description of Artificial Sequence: Synthetic oligonucleotide"
uaaaaguuucagugcgacgccgc

SEQ ID NO: 2498 - RNA, 23 nt, Artificial Sequence
  source: /note="Description of Artificial Sequence: Synthetic oligonucleotide"
uacgaaaaguuucagugcgacgc

SEQ ID NO: 2499 - RNA, 23 nt, Artificial Sequence
  source: /note="Description of Artificial Sequence: Synthetic oligonucleotide"
ugacgaaaaguuucagugcgacg

SEQ ID NO: 2500 - RNA, 23 nt, Artificial Sequence
  source: /note="Description of Artificial Sequence: Synthetic oligonucleotide"
uuuggacgaaaaguuucagugcg

SEQ ID NO: 2501 - RNA, 23 nt, Artificial Sequence
  source: /note="Description of Artificial Sequence: Synthetic oligonucleotide"
uguuggacgaaaaguuucagugc

SEQ ID NO: 2502 - RNA, 23 nt, Artificial Sequence
  source: /note="Description of Artificial Sequence: Synthetic oligonucleotide"
uaaguuggacgaaaaguuucagu

SEQ ID NO: 2503 - RNA, 23 nt, Artificial Sequence
  source: /note="Description of Artificial Sequence: Synthetic oligonucleotide"
ucagaaguuggacgaaaaguuuc

SEQ ID NO: 2504 - RNA, 23 nt, Artificial Sequence
  source: /note="Description of Artificial Sequence: Synthetic oligonucleotide"
uccgaagcgagaacagcccagaa

SEQ ID NO: 2505 - RNA, 23 nt, Artificial Sequence
  source: /note="Description of Artificial Sequence: Synthetic oligonucleotide"
uuccgaagcgagaacagcccaga

SEQ ID NO: 2506 - RNA, 23 nt, Artificial Sequence
  source: /note="Description of Artificial Sequence: Synthetic oligonucleotide"
ucuccgaagcgagaacagcccag

SEQ ID NO: 2507 - RNA, 23 nt, Artificial Sequence
  source: /note="Description of Artificial Sequence: Synthetic oligonucleotide"
uuccuccgaagcgagaacagccc

SEQ ID NO: 2508 - RNA, 23 nt, Artificial Sequence
  source: /note="Description of Artificial Sequence: Synthetic oligonucleotide"
ugagcuagcacuucucgcggcuc

SEQ ID NO: 2509 - RNA, 23 nt, Artificial Sequence
  source: /note="Description of Artificial Sequence: Synthetic oligonucleotide"
ucgagcuagcacuucucgcggcu

SEQ ID NO: 2510 - RNA, 23 nt, Artificial Sequence
  source: /note="Description of Artificial Sequence: Synthetic oligonucleotide"
uaaguucaugguuucggaggccc

SEQ ID NO: 2511 - RNA, 23 nt, Artificial Sequence
  source: /note="Description of Artificial Sequence: Synthetic oligonucleotide"
uaugauucugcccuccuccuucu

SEQ ID NO: 2512 - RNA, 23 nt, Artificial Sequence
  source: /note="Description of Artificial Sequence: Synthetic oligonucleotide"
ucacuucgugaugauucugcccu

SEQ ID NO: 2513 - RNA, 23 nt, Artificial Sequence
  source: /note="Description of Artificial Sequence: Synthetic oligonucleotide"
uuucaccacuucgugaugauucu

SEQ ID NO: 2514 - RNA, 23 nt, Artificial Sequence
  source: /note="Description of Artificial Sequence: Synthetic oligonucleotide"
ucuucaccacuucgugaugauuc

SEQ ID NO: 2515 - RNA, 23 nt, Artificial Sequence
  source: /note="Description of Artificial Sequence: Synthetic oligonucleotide"
uacuucaccacuucgugaugauu

SEQ ID NO: 2516 - RNA, 23 nt, Artificial Sequence
  source: /note="Description of Artificial Sequence: Synthetic oligonucleotide"
uaacuucaccacuucgugaugau

SEQ ID NO: 2517 - RNA, 23 nt, Artificial Sequence
  source: /note="Description of Artificial Sequence: Synthetic oligonucleotide"
uugaacuucaccacuucgugaug

SEQ ID NO: 2518 - RNA, 23 nt, Artificial Sequence
  source: /note="Description of Artificial Sequence: Synthetic oligonucleotide"
uauccaugaacuucaccacuucg

SEQ ID NO: 2519 - RNA, 23 nt, Artificial Sequence
  source: /note="Description of Artificial Sequence: Synthetic oligonucleotide"
ucauccaugaacuucaccacuuc

SEQ ID NO: 2520 - RNA, 23 nt, Artificial Sequence
  source: /note="Description of Artificial Sequence: Synthetic oligonucleotide"
uacauccaugaacuucaccacuu

SEQ ID NO: 2521 - RNA, 23 nt, Artificial Sequence
  source: /note="Description of Artificial Sequence: Synthetic oligonucleotide"
uagacauccaugaacuucaccac

SEQ ID NO: 2522 - RNA, 23 nt, Artificial Sequence
  source: /note="Description of Artificial Sequence: Synthetic oligonucleotide"
uuagacauccaugaacuucacca

SEQ ID NO: 2523 - RNA, 23 nt, Artificial Sequence
  source: /note="Description of Artificial Sequence: Synthetic oligonucleotide"
uauagacauccaugaacuucacc

SEQ ID NO: 2524 - RNA, 23 nt, Artificial Sequence
  source: /note="Description of Artificial Sequence: Synthetic oligonucleotide"
uugauagacauccaugaacuuca

SEQ ID NO: 2525 - RNA, 23 nt, Artificial Sequence
  source: /note="Description of Artificial Sequence: Synthetic oligonucleotide"
ucugauagacauccaugaacuuc

SEQ ID NO: 2526 - RNA, 23 nt, Artificial Sequence
  source: /note="Description of Artificial Sequence: Synthetic oligonucleotide"
ucgcugauagacauccaugaacu

SEQ ID NO: 2527 - RNA, 23 nt, Artificial Sequence
  source: /note="Description of Artificial Sequence: Synthetic oligonucleotide"
uuacuccuggaagauguccacca

SEQ ID NO: 2528 - RNA, 23 nt, Artificial Sequence
  source: /note="Description of Artificial Sequence: Synthetic oligonucleotide"
uuggcuugaagauguacucgauc

SEQ ID NO: 2529 - RNA, 23 nt, Artificial Sequence
  source: /note="Description of Artificial Sequence: Synthetic oligonucleotide"
uauggcuugaagauguacucgau

SEQ ID NO: 2530 - RNA, 23 nt, Artificial Sequence
  source: /note="Description of Artificial Sequence: Synthetic oligonucleotide"
ugauggcuugaagauguacucga

SEQ ID NO: 2531 - RNA, 23 nt, Artificial Sequence
  source: /note="Description of Artificial Sequence: Synthetic oligonucleotide"
uaggauggcuugaagauguacuc

SEQ ID NO: 2532 - RNA, 23 nt, Artificial Sequence
  source: /note="Description of Artificial Sequence: Synthetic oligonucleotide"
uaaucugcauggugauguuggac

SEQ ID NO: 2533 - RNA, 23 nt, Artificial Sequence
  source: /note="Description of Artificial Sequence: Synthetic oligonucleotide"
uuaaucugcauggugauguugga

SEQ ID NO: 2534 - RNA, 23 nt, Artificial Sequence
  source: /note="Description of Artificial Sequence: Synthetic oligonucleotide"
ucauaaucugcauggugauguug

SEQ ID NO: 2535 - RNA, 23 nt, Artificial Sequence
  source: /note="Description of Artificial Sequence: Synthetic oligonucleotide"
ugcauaaucugcauggugauguu

SEQ ID NO: 2536 - RNA, 23 nt, Artificial Sequence
  source: /note="Description of Artificial Sequence: Synthetic oligonucleotide"
uauccgcauaaucugcaugguga

SEQ ID NO: 2537 - RNA, 23 nt, Artificial Sequence
  source: /note="Description of Artificial Sequence: Synthetic oligonucleotide"
uuugauccgcauaaucugcaugg

SEQ ID NO: 2538 - RNA, 23 nt, Artificial Sequence
  source: /note="Description of Artificial Sequence: Synthetic oligonucleotide"
uuuugauccgcauaaucugcaug

SEQ ID NO: 2539 - RNA, 23 nt, Artificial Sequence
  source: /note="Description of Artificial Sequence: Synthetic oligonucleotide"
uguuugauccgcauaaucugcau

SEQ ID NO: 2540 - RNA, 23 nt, Artificial Sequence
  source: /note="Description of Artificial Sequence: Synthetic oligonucleotide"
ugagguuugauccgcauaaucug

SEQ ID NO: 2541 - RNA, 23 nt, Artificial Sequence
  source: /note="Description of Artificial Sequence: Synthetic oligonucleotide"
uugagguuugauccgcauaaucu

SEQ ID NO: 2542 - RNA, 23 nt, Artificial Sequence
  source: /note="Description of Artificial Sequence: Synthetic oligonucleotide"
uccuuggugagguuugauccgca

SEQ ID NO: 2543 - RNA, 23 nt, Artificial Sequence
  source: /note="Description of Artificial Sequence: Synthetic oligonucleotide"
uuguaggaagcucaucucuccua

SEQ ID NO: 2544 - RNA, 23 nt, Artificial Sequence
  source: /note="Description of Artificial Sequence: Synthetic oligonucleotide"
uugcuguaggaagcucaucucuc

SEQ ID NO: 2545 - RNA, 23 nt, Artificial Sequence
  source: /note="Description of Artificial Sequence: Synthetic oligonucleotide"
uugugcuguaggaagcucaucuc

SEQ ID NO: 2546 - RNA, 23 nt, Artificial Sequence
  source: /note="Description of Artificial Sequence: Synthetic oligonucleotide"
uuugugcuguaggaagcucaucu

SEQ ID NO: 2547 - RNA, 23 nt, Artificial Sequence
  source: /note="Description of Artificial Sequence: Synthetic oligonucleotide"
uuguugugcuguaggaagcucau

SEQ ID NO: 2548 - RNA, 23 nt, Artificial Sequence
  source: /note="Description of Artificial Sequence: Synthetic oligonucleotide"
uuuguugugcuguaggaagcuca

SEQ ID NO: 2549 - RNA, 23 nt, Artificial Sequence
  source: /note="Description of Artificial Sequence: Synthetic oligonucleotide"
uuuuguugugcuguaggaagcuc

SEQ ID NO: 2550 - RNA, 23 nt, Artificial Sequence
  source: /note="Description of Artificial Sequence: Synthetic oligonucleotide"
uauuuguugugcuguaggaagcu

SEQ ID NO: 2551 - RNA, 23 nt, Artificial Sequence
  source: /note="Description of Artificial Sequence: Synthetic oligonucleotide"
uacauuuguugugcuguaggaag

SEQ ID NO: 2552 - RNA, 23 nt, Artificial Sequence
  source: /note="Description of Artificial Sequence: Synthetic oligonucleotide"
uucacauuuguugugcuguagga

SEQ ID NO: 2553 - RNA, 23 nt, Artificial Sequence
  source: /note="Description of Artificial Sequence: Synthetic oligonucleotide"
uuucacauuuguugugcuguagg

SEQ ID NO: 2554 - RNA, 23 nt, Artificial Sequence
  source: /note="Description of Artificial Sequence: Synthetic oligonucleotide"
ugcauucacauuuguugugcugu

SEQ ID NO: 2555 - RNA, 23 nt, Artificial Sequence
  source: /note="Description of Artificial Sequence: Synthetic oligonucleotide"
uugcauucacauuuguugugcug

SEQ ID NO: 2556 - RNA, 23 nt, Artificial Sequence
  source: /note="Description of Artificial Sequence: Synthetic oligonucleotide"
uuaucagucuuuccuggugagag

SEQ ID NO: 2557 - RNA, 23 nt, Artificial Sequence
  source: /note="Description of Artificial Sequence: Synthetic oligonucleotide"
uguaucagucuuuccuggugaga

SEQ ID NO: 2558 - RNA, 23 nt, Artificial Sequence
  source: /note="Description of Artificial Sequence: Synthetic oligonucleotide"
uuguaucagucuuuccuggugag

SEQ ID NO: 2559 - RNA, 23 nt, Artificial Sequence
  source: /note="Description of Artificial Sequence: Synthetic oligonucleotide"
ucuguaucagucuuuccugguga

SEQ ID NO: 2560 - RNA, 23 nt, Artificial Sequence
  source: /note="Description of Artificial Sequence: Synthetic oligonucleotide"
uucuguaucagucuuuccuggug

SEQ ID NO: 2561 - RNA, 23 nt, Artificial Sequence
  source: /note="Description of Artificial Sequence: Synthetic oligonucleotide"
uuucuguaucagucuuuccuggu

SEQ ID NO: 2562 - RNA, 23 nt, Artificial Sequence
  source: /note="Description of Artificial Sequence: Synthetic oligonucleotide"
uguucuguaucagucuuuccugg

SEQ ID NO: 2563 - RNA, 23 nt, Artificial Sequence
  source: /note="Description of Artificial Sequence: Synthetic oligonucleotide"
ucguucuguaucagucuuuccug

SEQ ID NO: 2564 - RNA, 23 nt, Artificial Sequence
  source: /note="Description of Artificial Sequence: Synthetic oligonucleotide"
uucguucuguaucagucuuuccu

SEQ ID NO: 2565 - RNA, 23 nt, Artificial Sequence
  source: /note="Description of Artificial Sequence: Synthetic oligonucleotide"
uaucguucuguaucagucuuucc

SEQ ID NO: 2566 - RNA, 23 nt, Artificial Sequence
  source: /note="Description of Artificial Sequence: Synthetic oligonucleotide"
ugaucguucuguaucagucuuuc

SEQ ID NO: 2567 - RNA, 23 nt, Artificial Sequence
  source: /note="Description of Artificial Sequence: Synthetic oligonucleotide"
ucgaucguucuguaucagucuuu

SEQ ID NO: 2568 - RNA, 23 nt, Artificial Sequence
  source: /note="Description of Artificial Sequence: Synthetic oligonucleotide"
uucgaucguucuguaucagucuu

SEQ ID NO: 2569 - RNA, 23 nt, Artificial Sequence
  source: /note="Description of Artificial Sequence: Synthetic oligonucleotide"
uaucgaucguucuguaucagucu

SEQ ID NO: 2570 - RNA, 23 nt, Artificial Sequence
  source: /note="Description of Artificial Sequence: Synthetic oligonucleotide"
uuaucgaucguucuguaucaguc

SEQ ID NO: 2571 - RNA, 23 nt, Artificial Sequence
  source: /note="Description of Artificial Sequence: Synthetic oligonucleotide"
uguaucgaucguucuguaucagu

SEQ ID NO: 2572 - RNA, 23 nt, Artificial Sequence
  source: /note="Description of Artificial Sequence: Synthetic oligonucleotide"
uuguaucgaucguucuguaucag

SEQ ID NO: 2573 - RNA, 23 nt, Artificial Sequence
  source: /note="Description of Artificial Sequence: Synthetic oligonucleotide"
ucuguaucgaucguucuguauca

SEQ ID NO: 2574 - RNA, 23 nt, Artificial Sequence
  source: /note="Description of Artificial Sequence: Synthetic oligonucleotide"
uucuguaucgaucguucuguauc

SEQ ID NO: 2575 - RNA, 23 nt, Artificial Sequence
  source: /note="Description of Artificial Sequence: Synthetic oligonucleotide"
uuucuguaucgaucguucuguau

SEQ ID NO: 2576 - RNA, 23 nt, Artificial Sequence
  source: /note="Description of Artificial Sequence: Synthetic oligonucleotide"
uuuucuguaucgaucguucugua

SEQ ID NO: 2577 - RNA, 23 nt, Artificial Sequence
  source: /note="Description of Artificial Sequence: Synthetic oligonucleotide"
uguuucuguaucgaucguucugu

SEQ ID NO: 2578 - RNA, 23 nt, Artificial Sequence
  source: /note="Description of Artificial Sequence: Synthetic oligonucleotide"
ugguuucuguaucgaucguucug

SEQ ID NO: 2579 - RNA, 23 nt, Artificial Sequence
  source: /note="Description of Artificial Sequence: Synthetic oligonucleotide"
uugguuucuguaucgaucguucu

SEQ ID NO: 2580 - RNA, 23 nt, Artificial Sequence
  source: /note="Description of Artificial Sequence: Synthetic oligonucleotide"
ugugguuucuguaucgaucguuc

SEQ ID NO: 2581 - RNA, 23 nt, Artificial Sequence
  source: /note="Description of Artificial Sequence: Synthetic oligonucleotide"
ucgugguuucuguaucgaucguu

SEQ ID NO: 2582 - RNA, 23 nt, Artificial Sequence
  source: /note="Description of Artificial Sequence: Synthetic oligonucleotide"
uuucugucgauggugauggugug

SEQ ID NO: 2583 - RNA, 23 nt, Artificial Sequence
  source: /note="Description of Artificial Sequence: Synthetic oligonucleotide"
ucuguucugucgauggugauggu

SEQ ID NO: 2584 - RNA, 23 nt, Artificial Sequence
  source: /note="Description of Artificial Sequence: Synthetic oligonucleotide"
ugacuguucugucgauggugaug

SEQ ID NO: 2585 - RNA, 23 nt, Artificial Sequence
  source: /note="Description of Artificial Sequence: Synthetic oligonucleotide"
uggacuguucugucgauggugau

SEQ ID NO: 2586 - RNA, 23 nt, Artificial Sequence
  source: /note="Description of Artificial Sequence: Synthetic oligonucleotide"
uaggacuguucugucgaugguga

SEQ ID NO: 2587 - RNA, 23 nt, Artificial Sequence
  source: /note="Description of Artificial Sequence: Synthetic oligonucleotide"
uaaggacuguucugucgauggug

SEQ ID NO: 2588 - RNA, 23 nt, Artificial Sequence
  source: /note="Description of Artificial Sequence: Synthetic oligonucleotide"
uuaaggacuguucugucgauggu

SEQ ID NO: 2589 - RNA, 23 nt, Artificial Sequence
  source: /note="Description of Artificial Sequence: Synthetic oligonucleotide"
uuuaaggacuguucugucgaugg

SEQ ID NO: 2590 - RNA, 23 nt, Artificial Sequence
  source: /note="Description of Artificial Sequence: Synthetic oligonucleotide"
uauuaaggacuguucugucgaug

SEQ ID NO: 2591 - RNA, 23 nt, Artificial Sequence
  source: /note="Description of Artificial Sequence: Synthetic oligonucleotide"
ugauuaaggacuguucugucgau

SEQ ID NO: 2592 - RNA, 23 nt, Artificial Sequence
  source: /note="Description of Artificial Sequence: Synthetic oligonucleotide"
uggauuaaggacuguucugucga

SEQ ID NO: 2593 - RNA, 23 nt, Artificial Sequence
  source: /note="Description of Artificial Sequence: Synthetic oligonucleotide"
uuggauuaaggacuguucugucg

SEQ ID NO: 2594 - RNA, 23 nt, Artificial Sequence
  source: /note="Description of Artificial Sequence: Synthetic oligonucleotide"
uucuggauuaaggacuguucugu

SEQ ID NO: 2595 - RNA, 23 nt, Artificial Sequence
  source: /note="Description of Artificial Sequence: Synthetic oligonucleotide"
uuucuggauuaaggacuguucug

SEQ ID NO: 2596 - RNA, 23 nt, Artificial Sequence
  source: /note="Description of Artificial Sequence: Synthetic oligonucleotide"
uuuucuggauuaaggacuguucu

SEQ ID NO: 2597 - RNA, 23 nt, Artificial Sequence
  source: /note="Description of Artificial Sequence: Synthetic oligonucleotide"
uguuucuggauuaaggacuguuc

SEQ ID NO: 2598 - RNA, 23 nt, Artificial Sequence
  source: /note="Description of Artificial Sequence: Synthetic oligonucleotide"
ugguuucuggauuaaggacuguu

SEQ ID NO: 2599 - RNA, 23 nt, Artificial Sequence
  source: /note="Description of Artificial Sequence: Synthetic oligonucleotide"
uagguuucuggauuaaggacugu

SEQ ID NO: 2600 - RNA, 23 nt, Artificial Sequence
  source: /note="Description of Artificial Sequence: Synthetic oligonucleotide"
ucagguuucuggauuaaggacug

SEQ ID NO: 2601 - RNA, 23 nt, Artificial Sequence
  source: /note="Description of Artificial Sequence: Synthetic oligonucleotide"
uucagguuucuggauuaaggacu

SEQ ID NO: 2602 - RNA, 23 nt, Artificial Sequence
  source: /note="Description of Artificial Sequence: Synthetic oligonucleotide"
uuucagguuucuggauuaaggac

SEQ ID NO: 2603 - RNA, 23 nt, Artificial Sequence
  source: /note="Description of Artificial Sequence: Synthetic oligonucleotide"
uuuucagguuucuggauuaagga

SEQ ID NO: 2604 - RNA, 23 nt, Artificial Sequence
  source: /note="Description of Artificial Sequence: Synthetic oligonucleotide"
uauuucagguuucuggauuaagg

SEQ ID NO: 2605 - RNA, 23 nt, Artificial Sequence
  source: /note="Description of Artificial Sequence: Synthetic oligonucleotide"
uuccuucauuucagguuucugga

SEQ ID NO: 2606 - RNA, 23 nt, Artificial Sequence
  source: /note="Description of Artificial Sequence: Synthetic oligonucleotide"
uuuccuucauuucagguuucugg

SEQ ID NO: 2607 - RNA, 23 nt, Artificial Sequence
  source: /note="Description of Artificial Sequence: Synthetic oligonucleotide"
ucuuccuucauuucagguuucug

SEQ ID NO: 2608 - RNA, 23 nt, Artificial Sequence
  source: /note="Description of Artificial Sequence: Synthetic oligonucleotide"
uucuuccuucauuucagguuucu

SEQ ID NO: 2609 - RNA, 23 nt, Artificial Sequence
  source: /note="Description of Artificial Sequence: Synthetic oligonucleotide"
ucucuuccuucauuucagguuuc

SEQ ID NO: 2610 - RNA, 23 nt, Artificial Sequence
  source: /note="Description of Artificial Sequence: Synthetic oligonucleotide"
uuccucuuccuucauuucagguu

SEQ ID NO: 2611 - RNA, 23 nt, Artificial Sequence
  source: /note="Description of Artificial Sequence: Synthetic oligonucleotide"
uagagucuccucuuccuucauuu

SEQ ID NO: 2612 - RNA, 23 nt, Artificial Sequence
  source: /note="Description of Artificial Sequence: Synthetic oligonucleotide"
ugaauccaauuccaagagggacc

SEQ ID NO: 2613 - RNA, 23 nt, Artificial Sequence
  source: /note="Description of Artificial Sequence: Synthetic oligonucleotide"
ugcgaauccaauuccaagaggga

SEQ ID NO: 2614 - RNA, 23 nt, Artificial Sequence
  source: /note="Description of Artificial Sequence: Synthetic oligonucleotide"
uggcgaauccaauuccaagaggg

SEQ ID NO: 2615 - RNA, 23 nt, Artificial Sequence
  source: /note="Description of Artificial Sequence: Synthetic oligonucleotide"
uaauggcgaauccaauuccaaga

SEQ ID NO: 2616 - RNA, 23 nt, Artificial Sequence
  source: /note="Description of Artificial Sequence: Synthetic oligonucleotide"
uaaauggcgaauccaauuccaag

SEQ ID NO: 2617 - RNA, 23 nt, Artificial Sequence
  source: /note="Description of Artificial Sequence: Synthetic oligonucleotide"
uaaaauggcgaauccaauuccaa

SEQ ID NO: 2618 - RNA, 23 nt, Artificial Sequence
  source: /note="Description of Artificial Sequence: Synthetic oligonucleotide"
uuaaaauggcgaauccaauucca

SEQ ID NO: 2619 - RNA, 23 nt, Artificial Sequence
  source: /note="Description of Artificial Sequence: Synthetic oligonucleotide"
uauaaaauggcgaauccaauucc

SEQ ID NO: 2620 - RNA, 23 nt, Artificial Sequence
  source: /note="Description of Artificial Sequence: Synthetic oligonucleotide"
uaauaaaauggcgaauccaauuc

SEQ ID NO: 2621 - RNA, 23 nt, Artificial Sequence
  source: /note="Description of Artificial Sequence: Synthetic oligonucleotide"
uaaauaaaauggcgaauccaauu

SEQ ID NO: 2622 - RNA, 23 nt, Artificial Sequence
  source: /note="Description of Artificial Sequence: Synthetic oligonucleotide"
uaaaauaaaauggcgaauccaau

SEQ ID NO: 2623 - RNA, 23 nt, Artificial Sequence
  source: /note="Description of Artificial Sequence: Synthetic oligonucleotide"
uaaaaauaaaauggcgaauccaa

SEQ ID NO: 2624 - RNA, 23 nt, Artificial Sequence
  source: /note="Description of Artificial Sequence: Synthetic oligonucleotide"
ugaaaaauaaaauggcgaaucca

SEQ ID NO: 2625 - RNA, 23 nt, Artificial Sequence
  source: /note="Description of Artificial Sequence: Synthetic oligonucleotide"
ucaagaaaaauaaaauggcgaau

SEQ ID NO: 2626 - RNA, 23 nt, Artificial Sequence
  source: /note="Description of Artificial Sequence: Synthetic oligonucleotide"
ugcaagaaaaauaaaauggcgaa

SEQ ID NO: 2627 - RNA, 23 nt, Artificial Sequence
  source: /note="Description of Artificial Sequence: Synthetic oligonucleotide"
uagcaagaaaaauaaaauggcga

SEQ ID NO: 2628 - RNA, 23 nt, Artificial Sequence
  source: /note="Description of Artificial Sequence: Synthetic oligonucleotide"
ucagcaagaaaaauaaaauggcg

SEQ ID NO: 2629 - RNA, 23 nt, Artificial Sequence
  source: /note="Description of Artificial Sequence: Synthetic oligonucleotide"
ugcagcaagaaaaauaaaauggc

SEQ ID NO: 2630 - RNA, 23 nt, Artificial Sequence
  source: /note="Description of Artificial Sequence: Synthetic oligonucleotide"
uagcagcaagaaaaauaaaaugg

SEQ ID NO: 2631 - RNA, 23 nt, Artificial Sequence
  source: /note="Description of Artificial Sequence: Synthetic oligonucleotide"
uuagcagcaagaaaaauaaaaug

SEQ ID NO: 2632 - RNA, 23 nt, Artificial Sequence
  source: /note="Description of Artificial Sequence: Synthetic oligonucleotide"
uggugauuuagcagcaagaaaaa

SEQ ID NO: 2633 - RNA, 23 nt, Artificial Sequence
  source: /note="Description of Artificial Sequence: Synthetic oligonucleotide"
uuaaucuuccgggcucggugauu

SEQ ID NO: 2634 - RNA, 23 nt, Artificial Sequence
  source: /note="Description of Artificial Sequence: Synthetic oligonucleotide"
uaacucucuaaucuuccgggcuc

SEQ ID NO: 2635 - RNA, 23 nt, Artificial Sequence
  source: /note="Description of Artificial Sequence: Synthetic oligonucleotide"
uaaacucucuaaucuuccgggcu

SEQ ID NO: 2636 - RNA, 23 nt, Artificial Sequence
  source: /note="Description of Artificial Sequence: Synthetic oligonucleotide"
uuaaaacucucuaaucuuccggg

SEQ ID NO: 2637 - RNA, 23 nt, Artificial Sequence
  source: /note="Description of Artificial Sequence: Synthetic oligonucleotide"
uauaaaacucucuaaucuuccgg

SEQ ID NO: 2638 - RNA, 23 nt, Artificial Sequence
  source: /note="Description of Artificial Sequence: Synthetic oligonucleotide"
uaauaaaacucucuaaucuuccg

SEQ ID NO: 2639 - RNA, 23 nt, Artificial Sequence
  source: /note="Description of Artificial Sequence: Synthetic oligonucleotide"
uaaauaaaacucucuaaucuucc

SEQ ID NO: 2640 - RNA, 23 nt, Artificial Sequence
  source: /note="Description of Artificial Sequence: Synthetic oligonucleotide"
ugaaauaaaacucucuaaucuuc

SEQ ID NO: 2641 - RNA, 23 nt, Artificial Sequence
  source: /note="Description of Artificial Sequence: Synthetic oligonucleotide"
ucagaaauaaaacucucuaaucu

SEQ ID NO: 2642 - RNA, 23 nt, Artificial Sequence
  source: /note="Description of Artificial Sequence: Synthetic oligonucleotide"
uccagaaauaaaacucucuaauc

SEQ ID NO: 2643 - RNA, 23 nt, Artificial Sequence
  source: /note="Description of Artificial Sequence: Synthetic oligonucleotide"
ucccagaaauaaaacucucuaau

SEQ ID NO: 2644 - RNA, 23 nt, Artificial Sequence
  source: /note="Description of Artificial Sequence: Synthetic oligonucleotide"
uucccagaaauaaaacucucuaa

SEQ ID NO: 2645 - RNA, 23 nt, Artificial Sequence
  source: /note="Description of Artificial Sequence: Synthetic oligonucleotide"
uaucccagaaauaaaacucucua

SEQ ID NO: 2646 - RNA, 23 nt, Artificial Sequence
  source: /note="Description of Artificial Sequence: Synthetic oligonucleotide"
uaaucccagaaauaaaacucucu

SEQ ID NO: 2647 - RNA, 23 nt, Artificial Sequence
  source: /note="Description of Artificial Sequence: Synthetic oligonucleotide"
ugaaucccagaaauaaaacucuc

SEQ ID NO: 2648 - RNA, 23 nt, Artificial Sequence
  source: /note="Description of Artificial Sequence: Synthetic oligonucleotide"
uggaaucccagaaauaaaacucu

SEQ ID NO: 2649 - RNA, 23 nt, Artificial Sequence
  source: /note="Description of Artificial Sequence: Synthetic oligonucleotide"
uaggaaucccagaaauaaaacuc

SEQ ID NO: 2650 - RNA, 23 nt, Artificial Sequence
  source: /note="Description of Artificial Sequence: Synthetic oligonucleotide"
ucaggaaucccagaaauaaaacu

SEQ ID NO: 2651 - RNA, 23 nt, Artificial Sequence
  source: /note="Description of Artificial Sequence: Synthetic oligonucleotide"
uacaggaaucccagaaauaaaac

SEQ ID NO: 2652 - RNA, 23 nt, Artificial Sequence
  source: /note="Description of Artificial Sequence: Synthetic oligonucleotide"
uuacaggaaucccagaaauaaaa

SEQ ID NO: 2653 - RNA, 23 nt, Artificial Sequence
  source: /note="Description of Artificial Sequence: Synthetic oligonucleotide"
ucuacaggaaucccagaaauaaa

SEQ ID NO: 2654 - RNA, 23 nt, Artificial Sequence
  source: /note="Description of Artificial Sequence: Synthetic oligonucleotide"
uucuacaggaaucccagaaauaa

SEQ ID NO: 2655 - RNA, 23 nt, Artificial Sequence
  source: /note="Description of Artificial Sequence: Synthetic oligonucleotide"
ugucuacaggaaucccagaaaua

SEQ ID NO: 2656 - RNA, 23 nt, Artificial Sequence
  source: /note="Description of Artificial Sequence: Synthetic oligonucleotide"
ugugucuacaggaaucccagaaa

SEQ ID NO: 2657 - RNA, 23 nt, Artificial Sequence
  source: /note="Description of Artificial Sequence: Synthetic oligonucleotide"
uugugucuacaggaaucccagaa

SEQ ID NO: 2658 - RNA, 23 nt, Artificial Sequence
  source: /note="Description of Artificial Sequence: Synthetic oligonucleotide"
ugugugucuacaggaaucccaga

SEQ ID NO: 2659 - RNA, 23 nt, Artificial Sequence
  source: /note="Description of Artificial Sequence: Synthetic oligonucleotide"
uggugugucuacaggaaucccag

SEQ ID NO: 2660 - RNA, 23 nt, Artificial Sequence
  source: /note="Description of Artificial Sequence: Synthetic oligonucleotide"
uauguaugugggugggugugucu

SEQ ID NO: 2661 - RNA, 23 nt, Artificial Sequence
  source: /note="Description of Artificial Sequence: Synthetic oligonucleotide"
uauguauguaugugggugggugu

SEQ ID NO: 2662 - RNA, 23 nt, Artificial Sequence
  source: /note="Description of Artificial Sequence: Synthetic oligonucleotide"
uaauguauguaugugggugggug

SEQ ID NO: 2663 - RNA, 23 nt, Artificial Sequence
  source: /note="Description of Artificial Sequence: Synthetic oligonucleotide"
uaaauguauguaugugggugggu

SEQ ID NO: 2664 - RNA, 23 nt, Artificial Sequence
  source: /note="Description of Artificial Sequence: Synthetic oligonucleotide"
uuaaauguauguauguggguggg

SEQ ID NO: 2665 - RNA, 23 nt, Artificial Sequence
  source: /note="Description of Artificial Sequence: Synthetic oligonucleotide"
uauauaaauguauguaugugggu

SEQ ID NO: 2666 - RNA, 23 nt, Artificial Sequence
  source: /note="Description of Artificial Sequence: Synthetic oligonucleotide"
uuauauaaauguauguauguggg

SEQ ID NO: 2667 - RNA, 23 nt, Artificial Sequence
  source: /note="Description of Artificial Sequence: Synthetic oligonucleotide"
ucauuagcacuguuaauuuaaaa

SEQ ID NO: 2668 - RNA, 23 nt, Artificial Sequence
  source: /note="Description of Artificial Sequence: Synthetic oligonucleotide"
uacauuagcacuguuaauuuaaa

SEQ ID NO: 2669 - RNA, 23 nt, Artificial Sequence
  source: /note="Description of Artificial Sequence: Synthetic oligonucleotide"
uaacauuagcacuguuaauuuaa

SEQ ID NO: 2670 - RNA, 23 nt, Artificial Sequence
  source: /note="Description of Artificial Sequence: Synthetic oligonucleotide"
uuaacauuagcacuguuaauuua

SEQ ID NO: 2671 - RNA, 23 nt, Artificial Sequence
  source: /note="Description of Artificial Sequence: Synthetic oligonucleotide"
uauaacauuagcacuguuaauuu

SEQ ID NO: 2672 - RNA, 23 nt, Artificial Sequence
  source: /note="Description of Artificial Sequence: Synthetic oligonucleotide"
uaauaacauuagcacuguuaauu

SEQ ID NO: 2673 - RNA, 23 nt, Artificial Sequence
  source: /note="Description of Artificial Sequence: Synthetic oligonucleotide"
ucaauaacauuagcacuguuaau

SEQ ID NO: 2674 - RNA, 23 nt, Artificial Sequence
  source: /note="Description of Artificial Sequence: Synthetic oligonucleotide"
uccaauaacauuagcacuguuaa

SEQ ID NO: 2675 - RNA, 23 nt, Artificial Sequence
  source: /note="Description of Artificial Sequence: Synthetic oligonucleotide"
uaccaauaacauuagcacuguua

SEQ ID NO: 2676 - RNA, 23 nt, Artificial Sequence
  source: /note="Description of Artificial Sequence: Synthetic oligonucleotide"
ucaccaauaacauuagcacuguu

SEQ ID NO: 2677 - RNA, 23 nt, Artificial Sequence
  source: /note="Description of Artificial Sequence: Synthetic oligonucleotide"
ugacaccaauaacauuagcacug

SEQ ID NO: 2678 - RNA, 23 nt, Artificial Sequence
  source: /note="Description of Artificial Sequence: Synthetic oligonucleotide"
uagacaccaauaacauuagcacu

SEQ ID NO: 2679 - RNA, 23 nt, Artificial Sequence
  source: /note="Description of Artificial Sequence: Synthetic oligonucleotide"
uaagacaccaauaacauuagcac

SEQ ID NO: 2680 - RNA, 23 nt, Artificial Sequence
  source: /note="Description of Artificial Sequence: Synthetic oligonucleotide"
ugaagacaccaauaacauuagca

SEQ ID NO: 2681 - RNA, 23 nt, Artificial Sequence
  source: /note="Description of Artificial Sequence: Synthetic oligonucleotide"
uugaagacaccaauaacauuagc

SEQ ID NO: 2682 - RNA, 23 nt, Artificial Sequence
  source: /note="Description of Artificial Sequence: Synthetic oligonucleotide"
ugugaagacaccaauaacauuag

SEQ ID NO: 2683 - RNA, 23 nt, Artificial Sequence
  source: /note="Description of Artificial Sequence: Synthetic oligonucleotide"
uagugaagacaccaauaacauua

SEQ ID NO: 2684 - RNA, 23 nt, Artificial Sequence
  source: /note="Description of Artificial Sequence: Synthetic oligonucleotide"
ucagugaagacaccaauaacauu

SEQ ID NO: 2685 - RNA, 23 nt, Artificial Sequence
  source: /note="Description of Artificial Sequence: Synthetic oligonucleotide"
uccagugaagacaccaauaacau

SEQ ID NO: 2686 - RNA, 23 nt, Artificial Sequence
  source: /note="Description of Artificial Sequence: Synthetic oligonucleotide"
uuccagugaagacaccaauaaca

SEQ ID NO: 2687 - RNA, 23 nt, Artificial Sequence
  source: /note="Description of Artificial Sequence: Synthetic oligonucleotide"
uuacauccagugaagacaccaau

SEQ ID NO: 2688 - RNA, 23 nt, Artificial Sequence
  source: /note="Description of Artificial Sequence: Synthetic oligonucleotide"
uaaauacauccagugaagacacc

SEQ ID NO: 2689 - RNA, 23 nt, Artificial Sequence
  source: /note="Description of Artificial Sequence: Synthetic oligonucleotide"
ugcagucaaauacauccagugaa

SEQ ID NO: 2690 - RNA, 23 nt, Artificial Sequence
  source: /note="Description of Artificial Sequence: Synthetic oligonucleotide"
uagcagucaaauacauccaguga

SEQ ID NO: 2691 - RNA, 23 nt, Artificial Sequence
  source: /note="Description of Artificial Sequence: Synthetic oligonucleotide"
uacagcagucaaauacauccagu

SEQ ID NO: 2692 - RNA, 23 nt, Artificial Sequence
  source: /note="Description of Artificial Sequence: Synthetic oligonucleotide"
uaaguccacagcagucaaauaca

SEQ ID NO: 2693 - RNA, 23 nt, Artificial Sequence
  source: /note="Description of Artificial Sequence: Synthetic oligonucleotide"
uucaaguccacagcagucaaaua

SEQ ID NO: 2694 - RNA, 23 nt, Artificial Sequence
  source: /note="Description of Artificial Sequence: Synthetic oligonucleotide"
uucccaacucaaguccacagcag

SEQ ID NO: 2695 - RNA, 23 nt, Artificial Sequence
  source: /note="Description of Artificial Sequence: Synthetic oligonucleotide"
ucugucaggaucugagugggaac

SEQ ID NO: 2696 - RNA, 23 nt, Artificial Sequence
  source: /note="Description of Artificial Sequence: Synthetic oligonucleotide"
uccugucaggaucugagugggaa

SEQ ID NO: 2697 - RNA, 23 nt, Artificial Sequence
  source: /note="Description of Artificial Sequence: Synthetic oligonucleotide"
ucagagucucucaucuccuccuc

SEQ ID NO: 2698 - RNA, 23 nt, Artificial Sequence
  source: /note="Description of Artificial Sequence: Synthetic oligonucleotide"
uccagagucucucaucuccuccu

SEQ ID NO: 2699 - RNA, 23 nt, Artificial Sequence
  source: /note="Description of Artificial Sequence: Synthetic oligonucleotide"
uugccagagucucucaucuccuc

SEQ ID NO: 2700 - RNA, 23 nt, Artificial Sequence
  source: /note="Description of Artificial Sequence: Synthetic oligonucleotide"
uaaagaucaugccagagucucuc

SEQ ID NO: 2701 - RNA, 23 nt, Artificial Sequence
  source: /note="Description of Artificial Sequence: Synthetic oligonucleotide"
uaaaagaucaugccagagucucu

SEQ ID NO: 2702 - RNA, 23 nt, Artificial Sequence
  source: /note="Description of Artificial Sequence: Synthetic oligonucleotide"
uguuugucgguguucccaaaacu

SEQ ID NO: 2703 - RNA, 23 nt, Artificial Sequence
  source: /note="Description of Artificial Sequence: Synthetic oligonucleotide"
uacagcaauguccugaagcuccc

SEQ ID NO: 2704 - RNA, 23 nt, Artificial Sequence
  source: /note="Description of Artificial Sequence: Synthetic oligonucleotide"
ugcacagcaauguccugaagcuc

SEQ ID NO: 2705 - RNA, 23 nt, Artificial Sequence
  source: /note="Description of Artificial Sequence: Synthetic oligonucleotide"
uagcacagcaauguccugaagcu

SEQ ID NO: 2706 - RNA, 23 nt, Artificial Sequence
  source: /note="Description of Artificial Sequence: Synthetic oligonucleotide"
uaagcacagcaauguccugaagc

SEQ ID NO: 2707 - RNA, 23 nt, Artificial Sequence
  source: /note="Description of Artificial Sequence: Synthetic oligonucleotide"
uaaagcacagcaauguccugaag

SEQ ID NO: 2708 - RNA, 23 nt, Artificial Sequence
  source: /note="Description of Artificial Sequence: Synthetic oligonucleotide"
ucaaagcacagcaauguccugaa

SEQ ID NO: 2709 - RNA, 23 nt, Artificial Sequence
  source: /note="Description of Artificial Sequence: Synthetic oligonucleotide"
ugaagcaggugagaguaagcgaa

SEQ ID NO: 2710 - RNA, 23 nt, Artificial Sequence
  source: /note="Description of Artificial Sequence: Synthetic oligonucleotide"
uagaagcaggugagaguaagcga

SEQ ID NO: 2711 - RNA, 23 nt, Artificial Sequence
  source: /note="Description of Artificial Sequence: Synthetic oligonucleotide"
uucagaagcaggugagaguaagc

SEQ ID NO: 2712 - RNA, 23 nt, Artificial Sequence
  source: /note="Description of Artificial Sequence: Synthetic oligonucleotide"
uaacucagaagcaggugagagua

SEQ ID NO: 2713 - RNA, 23 nt, Artificial Sequence
  source: /note="Description of Artificial Sequence: Synthetic oligonucleotide"
ucaacucagaagcaggugagagu

SEQ ID NO: 2714 - RNA, 23 nt, Artificial Sequence
  source: /note="Description of Artificial Sequence: Synthetic oligonucleotide"
ugcaacucagaagcaggugagag

SEQ ID NO: 2715 - RNA, 23 nt, Artificial Sequence
  source: /note="Description of Artificial Sequence: Synthetic oligonucleotide"
uggcaacucagaagcaggugaga

SEQ ID NO: 2716 - RNA, 23 nt, Artificial Sequence
  source: /note="Description of Artificial Sequence: Synthetic oligonucleotide"
ugggcaacucagaagcaggugag

SEQ ID NO: 2717 - RNA, 23 nt, Artificial Sequence
  source: /note="Description of Artificial Sequence: Synthetic oligonucleotide"
uugggcaacucagaagcagguga

SEQ ID NO: 2718 - RNA, 23 nt, Artificial Sequence
  source: /note="Description of Artificial Sequence: Synthetic oligonucleotide"
ucugggcaacucagaagcaggug

SEQ ID NO: 2719 - RNA, 23 nt, Artificial Sequence
  source: /note="Description of Artificial Sequence: Synthetic oligonucleotide"
uugugucucuucucuucgccggg

SEQ ID NO: 2720 - RNA, 23 nt, Artificial Sequence
  source: /note="Description of Artificial Sequence: Synthetic oligonucleotide"
uaugugucucuucucuucgccgg

SEQ ID NO: 2721 - RNA, 23 nt, Artificial Sequence
  source: /note="Description of Artificial Sequence: Synthetic oligonucleotide"
uaaugugucucuucucuucgccg

SEQ ID NO: 2722 - RNA, 23 nt, Artificial Sequence
  source: /note="Description of Artificial Sequence: Synthetic oligonucleotide"
ucaaugugucucuucucuucgcc

SEQ ID NO: 2723 - RNA, 23 nt, Artificial Sequence
  source: /note="Description of Artificial Sequence: Synthetic oligonucleotide"
uacaaugugucucuucucuucgc

SEQ ID NO: 2724 - RNA, 23 nt, Artificial Sequence
  source: /note="Description of Artificial Sequence: Synthetic oligonucleotide"
uaacaaugugucucuucucuucg

SEQ ID NO: 2725 - RNA, 23 nt, Artificial Sequence
  source: /note="Description of Artificial Sequence: Synthetic oligonucleotide"
ucaacaaugugucucuucucuuc

SEQ ID NO: 2726 - RNA, 23 nt, Artificial Sequence
  source: /note="Description of Artificial Sequence: Synthetic oligonucleotide"
uccaacaaugugucucuucucuu

SEQ ID NO: 2727 - RNA, 23 nt, Artificial Sequence
  source: /note="Description of Artificial Sequence: Synthetic oligonucleotide"
uuccaacaaugugucucuucucu

SEQ ID NO: 2728 - RNA, 23 nt, Artificial Sequence
  source: /note="Description of Artificial Sequence: Synthetic oligonucleotide"
uuuccaacaaugugucucuucuc

SEQ ID NO: 2729 - RNA, 23 nt, Artificial Sequence
  source: /note="Description of Artificial Sequence: Synthetic oligonucleotide"
ucuuccaacaaugugucucuucu

SEQ ID NO: 2730 - RNA, 23 nt, Artificial Sequence
  source: /note="Description of Artificial Sequence: Synthetic oligonucleotide"
uucuuccaacaaugugucucuuc

SEQ ID NO: 2731 - RNA, 23 nt, Artificial Sequence
  source: /note="Description of Artificial Sequence: Synthetic oligonucleotide"
uuucuuccaacaaugugucucuu

SEQ ID NO: 2732 - RNA, 23 nt, Artificial Sequence
  source: /note="Description of Artificial Sequence: Synthetic oligonucleotide"
ucuucuuccaacaaugugucucu

SEQ ID NO: 2733 - RNA, 23 nt, Artificial Sequence
  source: /note="Description of Artificial Sequence: Synthetic oligonucleotide"
ugcuucuuccaacaaugugucuc

SEQ ID NO: 2734 - RNA, 23 nt, Artificial Sequence
  source: /note="Description of Artificial Sequence: Synthetic oligonucleotide"
uugcuucuuccaacaaugugucu

SEQ ID NO: 2735 - RNA, 23 nt, Artificial Sequence
  source: /note="Description of Artificial Sequence: Synthetic oligonucleotide"
ucugcuucuuccaacaauguguc

SEQ ID NO: 2736 - RNA, 23 nt, Artificial Sequence
  source: /note="Description of Artificial Sequence: Synthetic oligonucleotide"
uuucaauggugugaggacauagg

SEQ ID NO: 2737 - RNA, 23 nt, Artificial Sequence
  source: /note="Description of Artificial Sequence: Synthetic oligonucleotide"
uugguuucaauggugugaggaca

SEQ ID NO: 2738 - RNA, 23 nt, Artificial Sequence
  source: /note="Description of Artificial Sequence: Synthetic oligonucleotide"
ugugguuucaauggugugaggac

SEQ ID NO: 2739 - RNA, 23 nt, Artificial Sequence
  source: /note="Description of Artificial Sequence: Synthetic oligonucleotide"
uagugguuucaauggugugagga

SEQ ID NO: 2740 - RNA, 23 nt, Artificial Sequence
  source: /note="Description of Artificial Sequence: Synthetic oligonucleotide"
uuagugguuucaauggugugagg

SEQ ID NO: 2741 - RNA, 23 nt, Artificial Sequence
  source: /note="Description of Artificial Sequence: Synthetic oligonucleotide"
ucuagugguuucaauggugugag

SEQ ID NO: 2742 - RNA, 23 nt, Artificial Sequence
  source: /note="Description of Artificial Sequence: Synthetic oligonucleotide"
uagaacuagugguuucaauggug

SEQ ID NO: 2743 - RNA, 23 nt, Artificial Sequence
  source: /note="Description of Artificial Sequence: Synthetic oligonucleotide"
ucagaacuagugguuucaauggu

SEQ ID NO: 2744 - RNA, 23 nt, Artificial Sequence
  source: /note="Description of Artificial Sequence: Synthetic oligonucleotide"
uacagaacuagugguuucaaugg

SEQ ID NO: 2745 - RNA, 23 nt, Artificial Sequence
  source: /note="Description of Artificial Sequence: Synthetic oligonucleotide"
ugacagaacuagugguuucaaug

SEQ ID NO: 2746 - RNA, 23 nt, Artificial Sequence
  source: /note="Description of Artificial Sequence: Synthetic oligonucleotide"
uggacagaacuagugguuucaau

SEQ ID NO: 2747 - RNA, 23 nt, Artificial Sequence
  source: /note="Description of Artificial Sequence: Synthetic oligonucleotide"
ucacacacacacaaccaggucuc

SEQ ID NO: 2748 - RNA, 23 nt, Artificial Sequence
  source: /note="Description of Artificial Sequence: Synthetic oligonucleotide"
uucacacacacacaaccaggucu

SEQ ID NO: 2749 - RNA, 23 nt, Artificial Sequence
  source: /note="Description of Artificial Sequence: Synthetic oligonucleotide"
ucucacacacacacaaccagguc

SEQ ID NO: 2750 - RNA, 23 nt, Artificial Sequence
  source: /note="Description of Artificial Sequence: Synthetic oligonucleotide"
uacucacacacacacaaccaggu

SEQ ID NO: 2751 - RNA, 23 nt, Artificial Sequence
  source: /note="Description of Artificial Sequence: Synthetic oligonucleotide"
ucacucacacacacacaaccagg

SEQ ID NO: 2752 - RNA, 23 nt, Artificial Sequence
  source: /note="Description of Artificial Sequence: Synthetic oligonucleotide"
uccacucacacacacacaaccag

SEQ ID NO: 2753 - RNA, 23 nt, Artificial Sequence
  source: /note="Description of Artificial Sequence: Synthetic oligonucleotide"
uucaaccacucacacacacacaa

SEQ ID NO: 2754 - RNA, 23 nt, Artificial Sequence
  source: /note="Description of Artificial Sequence: Synthetic oligonucleotide"
ugucaaccacucacacacacaca

SEQ ID NO: 2755 - RNA, 23 nt, Artificial Sequence
  source: /note="Description of Artificial Sequence: Synthetic oligonucleotide"
uaggucaaccacucacacacaca

SEQ ID NO: 2756 - RNA, 23 nt, Artificial Sequence
  source: /note="Description of Artificial Sequence: Synthetic oligonucleotide"
ugaaggucaaccacucacacaca

SEQ ID NO: 2757 - RNA, 23 nt, Artificial Sequence
  source: /note="Description of Artificial Sequence: Synthetic oligonucleotide"
uggaaggucaaccacucacacac

SEQ ID NO: 2758 - RNA, 23 nt, Artificial Sequence
  source: /note="Description of Artificial Sequence: Synthetic oligonucleotide"
uaggaaggucaaccacucacaca

SEQ ID NO: 2759 - RNA, 23 nt, Artificial Sequence
  source: /note="Description of Artificial Sequence: Synthetic oligonucleotide"
uggaggaaggucaaccacucaca

SEQ ID NO: 2760 - RNA, 23 nt, Artificial Sequence
  source: /note="Description of Artificial Sequence: Synthetic oligonucleotide"
ugauggaggaaggucaaccacuc

SEQ ID NO: 2761 - RNA, 23 nt, Artificial Sequence
  source: /note="Description of Artificial Sequence: Synthetic oligonucleotide"
uucuuuucucugccuccacaaug

SEQ ID NO: 2762 - RNA, 23 nt, Artificial Sequence
  source: /note="Description of Artificial Sequence: Synthetic oligonucleotide"
ucucuuuucucugccuccacaau

SEQ ID NO: 2763 - RNA, 23 nt, Artificial Sequence
  source: /note="Description of Artificial Sequence: Synthetic oligonucleotide"
uucucuuuucucugccuccacaa

SEQ ID NO: 2764 - RNA, 23 nt, Artificial Sequence
  source: /note="Description of Artificial Sequence: Synthetic oligonucleotide"
uuucucuuuucucugccuccaca

SEQ ID NO: 2765 - RNA, 23 nt, Artificial Sequence
  source: /note="Description of Artificial Sequence: Synthetic oligonucleotide"
uuuucucuuuucucugccuccac

SEQ ID NO: 2766 - RNA, 23 nt, Artificial Sequence
  source: /note="Description of Artificial Sequence: Synthetic oligonucleotide"
ucuuucucuuuucucugccucca

SEQ ID NO: 2767 - RNA, 23 nt, Artificial Sequence
  source: /note="Description of Artificial Sequence: Synthetic oligonucleotide"
uacuuucucuuuucucugccucc

SEQ ID NO: 2768 - RNA, 23 nt, Artificial Sequence
  source: /note="Description of Artificial Sequence: Synthetic oligonucleotide"
ucacuuucucuuuucucugccuc

SEQ ID NO: 2769 - RNA, 23 nt, Artificial Sequence
  source: /note="Description of Artificial Sequence: Synthetic oligonucleotide"
uacacuuucucuuuucucugccu

SEQ ID NO: 2770 - RNA, 23 nt, Artificial Sequence
  source: /note="Description of Artificial Sequence: Synthetic oligonucleotide"
uaacacuuucucuuuucucugcc

SEQ ID NO: 2771 - RNA, 23 nt, Artificial Sequence
  source: /note="Description of Artificial Sequence: Synthetic oligonucleotide"
uaaacacuuucucuuuucucugc

SEQ ID NO: 2772 - RNA, 23 nt, Artificial Sequence
  source: /note="Description of Artificial Sequence: Synthetic oligonucleotide"
uaaaacacuuucucuuuucucug

SEQ ID NO: 2773 - RNA, 23 nt, Artificial Sequence
  source: /note="Description of Artificial Sequence: Synthetic oligonucleotide"
uuaaaacacuuucucuuuucucu

SEQ ID NO: 2774 - RNA, 23 nt, Artificial Sequence
  source: /note="Description of Artificial Sequence: Synthetic oligonucleotide"
uauaaaacacuuucucuuuucuc

SEQ ID NO: 2775 - RNA, 23 nt, Artificial Sequence
  source: /note="Description of Artificial Sequence: Synthetic oligonucleotide"
uuauaaaacacuuucucuuuucu

SEQ ID NO: 2776 - RNA, 23 nt, Artificial Sequence
  source: /note="Description of Artificial Sequence: Synthetic oligonucleotide"
uauauaaaacacuuucucuuuuc

SEQ ID NO: 2777 - RNA, 23 nt, Artificial Sequence
  source: /note="Description of Artificial Sequence: Synthetic oligonucleotide"
uuauauaaaacacuuucucuuuu

SEQ ID NO: 2778 - RNA, 23 nt, Artificial Sequence
  source: /note="Description of Artificial Sequence: Synthetic oligonucleotide"
uguauauaaaacacuuucucuuu

SEQ ID NO: 2779 - RNA, 23 nt, Artificial Sequence
  source: /note="Description of Artificial Sequence: Synthetic oligonucleotide"
ucguauauaaaacacuuucucuu

SEQ ID NO: 2780 - RNA, 23 nt, Artificial Sequence
  source: /note="Description of Artificial Sequence: Synthetic oligonucleotide"
uccguauauaaaacacuuucucu

SEQ ID NO: 2781 - RNA, 23 nt, Artificial Sequence
  source: /note="Description of Artificial Sequence: Synthetic oligonucleotide"
uuaccguauauaaaacacuuucu

SEQ ID NO: 2782 - RNA, 23 nt, Artificial Sequence
  source: /note="Description of Artificial Sequence: Synthetic oligonucleotide"
uguaccguauauaaaacacuuuc

SEQ ID NO: 2783 - RNA, 23 nt, Artificial Sequence
  source: /note="Description of Artificial Sequence: Synthetic oligonucleotide"
uaguaccguauauaaaacacuuu

SEQ ID NO: 2784 - RNA, 23 nt, Artificial Sequence
  source: /note="Description of Artificial Sequence: Synthetic oligonucleotide"
uaaguaccguauauaaaacacuu

SEQ ID NO: 2785 - RNA, 23 nt, Artificial Sequence
  source: /note="Description of Artificial Sequence: Synthetic oligonucleotide"
uuaaguaccguauauaaaacacu

SEQ ID NO: 2786 - RNA, 23 nt, Artificial Sequence
  source: /note="Description of Artificial Sequence: Synthetic oligonucleotide"
uauaaguaccguauauaaaacac

SEQ ID NO: 2787 - RNA, 23 nt, Artificial Sequence
  source: /note="Description of Artificial Sequence: Synthetic oligonucleotide"
uaauaaguaccguauauaaaaca

SEQ ID NO: 2788 - RNA, 23 nt, Artificial Sequence
  source: /note="Description of Artificial Sequence: Synthetic oligonucleotide"
uaaauaaguaccguauauaaaac

SEQ ID NO: 2789 - RNA, 23 nt, Artificial Sequence
  source: /note="Description of Artificial Sequence: Synthetic oligonucleotide"
uuaaauaaguaccguauauaaaa

SEQ ID NO: 2790 - RNA, 23 nt, Artificial Sequence
  source: /note="Description of Artificial Sequence: Synthetic oligonucleotide"
uuuaaauaaguaccguauauaaa

SEQ ID NO: 2791 - RNA, 23 nt, Artificial Sequence
  source: /note="Description of Artificial Sequence: Synthetic oligonucleotide"
uaagggauauuaaauaaguaccg

SEQ ID NO: 2792 - RNA, 23 nt, Artificial Sequence
  source: /note="Description of Artificial Sequence: Synthetic oligonucleotide"
uaaagggauauuaaauaaguacc

SEQ ID NO: 2793 - RNA, 23 nt, Artificial Sequence
  source: /note="Description of Artificial Sequence: Synthetic oligonucleotide"
ugcaaaagauacaucucauaaau

SEQ ID NO: 2794 - RNA, 23 nt, Artificial Sequence
  source: /note="Description of Artificial Sequence: Synthetic oligonucleotide"
uagcaaaagauacaucucauaaa

SEQ ID NO: 2795 - RNA, 23 nt, Artificial Sequence
  source: /note="Description of Artificial Sequence: Synthetic oligonucleotide"
ugagcaaaagauacaucucauaa

SEQ ID NO: 2796 - RNA, 23 nt, Artificial Sequence
  source: /note="Description of Artificial Sequence: Synthetic oligonucleotide"
uagagcaaaagauacaucucaua

SEQ ID NO: 2797 - RNA, 23 nt, Artificial Sequence
  source: /note="Description of Artificial Sequence: Synthetic oligonucleotide"
ugagagcaaaagauacaucucau

SEQ ID NO: 2798 - RNA, 23 nt, Artificial Sequence
  source: /note="Description of Artificial Sequence: Synthetic oligonucleotide"
uagagagcaaaagauacaucuca

SEQ ID NO: 2799 - RNA, 23 nt, Artificial Sequence
  source: /note="Description of Artificial Sequence: Synthetic oligonucleotide"
ugagagagcaaaagauacaucuc

SEQ ID NO: 2800 - RNA, 23 nt, Artificial Sequence
  source: /note="Description of Artificial Sequence: Synthetic oligonucleotide"
uagagagagcaaaagauacaucu

SEQ ID NO: 2801 - RNA, 23 nt, Artificial Sequence
  source: /note="Description of Artificial Sequence: Synthetic oligonucleotide"
uauaagagagcaagagagagcaa

SEQ ID NO: 2802 - RNA, 23 nt, Artificial Sequence
  source: /note="Description of Artificial Sequence: Synthetic oligonucleotide"
uaauaagagagcaagagagagca

SEQ ID NO: 2803 - RNA, 23 nt, Artificial Sequence
  source: /note="Description of Artificial Sequence: Synthetic oligonucleotide"
uaaauaagagagcaagagagagc

SEQ ID NO: 2804 - RNA, 23 nt, Artificial Sequence
  source: /note="Description of Artificial Sequence: Synthetic oligonucleotide"
ucaaauaagagagcaagagagag

SEQ ID NO: 2805 - RNA, 23 nt, Artificial Sequence
  source: /note="Description of Artificial Sequence: Synthetic oligonucleotide"
uacaaauaagagagcaagagaga

SEQ ID NO: 2806 - RNA, 23 nt, Artificial Sequence
  source: /note="Description of Artificial Sequence: Synthetic oligonucleotide"
uuacaaauaagagagcaagagag

SEQ ID NO: 2807 - RNA, 23 nt, Artificial Sequence
  source: /note="Description of Artificial Sequence: Synthetic oligonucleotide"
uguacaaauaagagagcaagaga

SEQ ID NO: 2808 - RNA, 23 nt, Artificial Sequence
  source: /note="Description of Artificial Sequence: Synthetic oligonucleotide"
ugguacaaauaagagagcaagag

SEQ ID NO: 2809 - RNA, 23 nt, Artificial Sequence
  source: /note="Description of Artificial Sequence: Synthetic oligonucleotide"
ucgguacaaauaagagagcaaga

SEQ ID NO: 2810 - RNA, 23 nt, Artificial Sequence
  source: /note="Description of Artificial Sequence: Synthetic oligonucleotide"
uccgguacaaauaagagagcaag

SEQ ID NO: 2811 - RNA, 23 nt, Artificial Sequence
  source: /note="Description of Artificial Sequence: Synthetic oligonucleotide"
uaaccgguacaaauaagagagca

SEQ ID NO: 2812 - RNA, 23 nt, Artificial Sequence
  source: /note="Description of Artificial Sequence: Synthetic oligonucleotide"
uaaaccgguacaaauaagagagc

SEQ ID NO: 2813 - RNA, 23 nt, Artificial Sequence
  source: /note="Description of Artificial Sequence: Synthetic oligonucleotide"
uaaaaccgguacaaauaagagag

SEQ ID NO: 2814 - RNA, 23 nt, Artificial Sequence
  source: /note="Description of Artificial Sequence: Synthetic oligonucleotide"
uaaaaaccgguacaaauaagaga

SEQ ID NO: 2815 - RNA, 23 nt, Artificial Sequence
  source: /note="Description of Artificial Sequence: Synthetic oligonucleotide"
ucaaaaaccgguacaaauaagag

SEQ ID NO: 2816 - RNA, 23 nt, Artificial Sequence
  source: /note="Description of Artificial Sequence: Synthetic oligonucleotide"
uacaaaaaccgguacaaauaaga

SEQ ID NO: 2817 - RNA, 23 nt, Artificial Sequence
  source: /note="Description of Artificial Sequence: Synthetic oligonucleotide"
uuacaaaaaccgguacaaauaag

SEQ ID NO: 2818 - RNA, 23 nt, Artificial Sequence
  source: /note="Description of Artificial Sequence: Synthetic oligonucleotide"
uauacaaaaaccgguacaaauaa

SEQ ID NO: 2819 - RNA, 23 nt, Artificial Sequence
  source: /note="Description of Artificial Sequence: Synthetic oligonucleotide"
uuauacaaaaaccgguacaaaua

SEQ ID NO: 2820 - RNA, 23 nt, Artificial Sequence
  source: /note="Description of Artificial Sequence: Synthetic oligonucleotide"
uauauacaaaaaccgguacaaau

SEQ ID NO: 2821 - RNA, 23 nt, Artificial Sequence
  source: /note="Description of Artificial Sequence: Synthetic oligonucleotide"
uuauauacaaaaaccgguacaaa

SEQ ID NO: 2822 - RNA, 23 nt, Artificial Sequence
  source: /note="Description of Artificial Sequence: Synthetic oligonucleotide"
uuuauauacaaaaaccgguacaa

SEQ ID NO: 2823 - RNA, 23 nt, Artificial Sequence
  source: /note="Description of Artificial Sequence: Synthetic oligonucleotide"
uuuuauauacaaaaaccgguaca

SEQ ID NO: 2824 - RNA, 23 nt, Artificial Sequence
  source: /note="Description of Artificial Sequence: Synthetic oligonucleotide"
uuuuuauauacaaaaaccgguac

SEQ ID NO: 2825 - RNA, 23 nt, Artificial Sequence
  source: /note="Description of Artificial Sequence: Synthetic oligonucleotide"
ugagagauuggaaacaugaauuu

SEQ ID NO: 2826 - RNA, 23 nt, Artificial Sequence
  source: /note="Description of Artificial Sequence: Synthetic oligonucleotide"
uagagagauuggaaacaugaauu

SEQ ID NO: 2827 - RNA, 23 nt, Artificial Sequence
  source: /note="Description of Artificial Sequence: Synthetic oligonucleotide"
ugagagagauuggaaacaugaau

SEQ ID NO: 2828 - RNA, 23 nt, Artificial Sequence
  source: /note="Description of Artificial Sequence: Synthetic oligonucleotide"
uagagagagauuggaaacaugaa

SEQ ID NO: 2829 - RNA, 23 nt, Artificial Sequence
  source: /note="Description of Artificial Sequence: Synthetic oligonucleotide"
ugagagagagauuggaaacauga

SEQ ID NO: 2830 - RNA, 23 nt, Artificial Sequence
  source: /note="Description of Artificial Sequence: Synthetic oligonucleotide"
uggagagagagauuggaaacaug

SEQ ID NO: 2831 - RNA, 23 nt, Artificial Sequence
  source: /note="Description of Artificial Sequence: Synthetic oligonucleotide"
uagggagagagagauuggaaaca

SEQ ID NO: 2832 - RNA, 23 nt, Artificial Sequence
  source: /note="Description of Artificial Sequence: Synthetic oligonucleotide"
uucagggagagagagauuggaaa

SEQ ID NO: 2833 - RNA, 23 nt, Artificial Sequence
  source: /note="Description of Artificial Sequence: Synthetic oligonucleotide"
uuaagcuagugacugucaccgau

SEQ ID NO: 2834 - RNA, 23 nt, Artificial Sequence
  source: /note="Description of Artificial Sequence: Synthetic oligonucleotide"
uauaagcuagugacugucaccga

SEQ ID NO: 2835 - RNA, 23 nt, Artificial Sequence
  source: /note="Description of Artificial Sequence: Synthetic oligonucleotide"
uuucaagauaagcuagugacugu

SEQ ID NO: 2836 - RNA, 23 nt, Artificial Sequence
  source: /note="Description of Artificial Sequence: Synthetic oligonucleotide"
uguucaagauaagcuagugacug

SEQ ID NO: 2837 - RNA, 23 nt, Artificial Sequence
  source: /note="Description of Artificial Sequence: Synthetic oligonucleotide"
uuguucaagauaagcuagugacu

SEQ ID NO: 2838 - RNA, 23 nt, Artificial Sequence
  source: /note="Description of Artificial Sequence: Synthetic oligonucleotide"
uucuguucaagauaagcuaguga

SEQ ID NO: 2839 - RNA, 23 nt, Artificial Sequence
  source: /note="Description of Artificial Sequence: Synthetic oligonucleotide"
uaucuguucaagauaagcuagug

SEQ ID NO: 2840 - RNA, 23 nt, Artificial Sequence
  source: /note="Description of Artificial Sequence: Synthetic oligonucleotide"
uuaucuguucaagauaagcuagu

SEQ ID NO: 2841 - RNA, 23 nt, Artificial Sequence
  source: /note="Description of Artificial Sequence: Synthetic oligonucleotide"
uauaucuguucaagauaagcuag

SEQ ID NO: 2842 - RNA, 23 nt, Artificial Sequence
  source: /note="Description of Artificial Sequence: Synthetic oligonucleotide"
uaauaucuguucaagauaagcua

SEQ ID NO: 2843 - RNA, 23 nt, Artificial Sequence
  source: /note="Description of Artificial Sequence: Synthetic oligonucleotide"
uuuucaaaggaaugugugcuggg

SEQ ID NO: 2844 - RNA, 23 nt, Artificial Sequence
  source: /note="Description of Artificial Sequence: Synthetic oligonucleotide"
uauuucaaaggaaugugugcugg

SEQ ID NO: 2845 - RNA, 23 nt, Artificial Sequence
  source: /note="Description of Artificial Sequence: Synthetic oligonucleotide"
uuauuucaaaggaaugugugcug

SEQ ID NO: 2846 - RNA, 23 nt, Artificial Sequence
  source: /note="Description of Artificial Sequence: Synthetic oligonucleotide"
uuuauuucaaaggaaugugugcu

SEQ ID NO: 2847 - RNA, 23 nt, Artificial Sequence
  source: /note="Description of Artificial Sequence: Synthetic oligonucleotide"
uccuuauuucaaaggaaugugug

SEQ ID NO: 2848 - RNA, 23 nt, Artificial Sequence
  source: /note="Description of Artificial Sequence: Synthetic oligonucleotide"
uugaaaccuuauuucaaaggaau

SEQ ID NO: 2849 - RNA, 23 nt, Artificial Sequence
  source: /note="Description of Artificial Sequence: Synthetic oligonucleotide"
uauugaaaccuuauuucaaagga

SEQ ID NO: 2850 - RNA, 23 nt, Artificial Sequence
  source: /note="Description of Artificial Sequence: Synthetic oligonucleotide"
uuauugaaaccuuauuucaaagg

SEQ ID NO: 2851 - RNA, 23 nt, Artificial Sequence
  source: /note="Description of Artificial Sequence: Synthetic oligonucleotide"
uguagauguauauugaaaccuua

SEQ ID NO: 2852 - RNA, 23 nt, Artificial Sequence
  source: /note="Description of Artificial Sequence: Synthetic oligonucleotide"
uuguagauguauauugaaaccuu

SEQ ID NO: 2853 - RNA, 23 nt, Artificial Sequence
  source: /note="Description of Artificial Sequence: Synthetic oligonucleotide"
uauguagauguauauugaaaccu

SEQ ID NO: 2854 - RNA, 23 nt, Artificial Sequence
  source: /note="Description of Artificial Sequence: Synthetic oligonucleotide"
uuauguagauguauauugaaacc

SEQ ID NO: 2855 - RNA, 23 nt, Artificial Sequence
  source: /note="Description of Artificial Sequence: Synthetic oligonucleotide"
uguauguagauguauauugaaac

SEQ ID NO: 2856 - RNA, 23 nt, Artificial Sequence
  source: /note="Description of Artificial Sequence: Synthetic oligonucleotide"
ucaaauacaaguugccaaauaua

SEQ ID NO: 2857 - RNA, 23 nt, Artificial Sequence
  source: /note="Description of Artificial Sequence: Synthetic oligonucleotide"
ucacaaauacaaguugccaaaua

SEQ ID NO: 2858 - RNA, 23 nt, Artificial Sequence
  source: /note="Description of Artificial Sequence: Synthetic oligonucleotide"
ucacacaaauacaaguugccaaa

SEQ ID NO: 2859 - RNA, 23 nt, Artificial Sequence
  source: /note="Description of Artificial Sequence: Synthetic oligonucleotide"
uacacacaaauacaaguugccaa

SEQ ID NO: 2860 - RNA, 23 nt, Artificial Sequence
  source: /note="Description of Artificial Sequence: Synthetic oligonucleotide"
uuacacacaaauacaaguugcca

SEQ ID NO: 2861 - RNA, 23 nt, Artificial Sequence
  source: /note="Description of Artificial Sequence: Synthetic oligonucleotide"
uauacacacaaauacaaguugcc

SEQ ID NO: 2862 - RNA, 23 nt, Artificial Sequence
  source: /note="Description of Artificial Sequence: Synthetic oligonucleotide"
uuauacacacaaauacaaguugc

SEQ ID NO: 2863 - RNA, 23 nt, Artificial Sequence
  source: /note="Description of Artificial Sequence: Synthetic oligonucleotide"
uauauacacacaaauacaaguug

SEQ ID NO: 2864 - RNA, 23 nt, Artificial Sequence
  source: /note="Description of Artificial Sequence: Synthetic oligonucleotide"
ucaaugucuauuuuaucagaauc

SEQ ID NO: 2865 - RNA, 23 nt, Artificial Sequence
  source: /note="Description of Artificial Sequence: Synthetic oligonucleotide"
uuagcaaugucuauuuuaucaga

SEQ ID NO: 2866 - RNA, 23 nt, Artificial Sequence
  source: /note="Description of Artificial Sequence: Synthetic oligonucleotide"
uauagcaaugucuauuuuaucag

SEQ ID NO: 2867 - RNA, 23 nt, Artificial Sequence
  source: /note="Description of Artificial Sequence: Synthetic oligonucleotide"
ugaauagcaaugucuauuuuauc

SEQ ID NO: 2868 - RNA, 23 nt, Artificial Sequence
  source: /note="Description of Artificial Sequence: Synthetic oligonucleotide"
uaaacagaauagcaaugucuauu

SEQ ID NO: 2869 - RNA, 23 nt, Artificial Sequence
  source: /note="Description of Artificial Sequence: Synthetic oligonucleotide"
uaaaacagaauagcaaugucuau

SEQ ID NO: 2870 - RNA, 23 nt, Artificial Sequence
  source: /note="Description of Artificial Sequence: Synthetic oligonucleotide"
uagagagauuuaguauguagaau

SEQ ID NO: 2871 - RNA, 23 nt, Artificial Sequence
  source: /note="Description of Artificial Sequence: Synthetic oligonucleotide"
ugagagagauuuaguauguagaa

SEQ ID NO: 2872 - RNA, 23 nt, Artificial Sequence
  source: /note="Description of Artificial Sequence: Synthetic oligonucleotide"
uggagagagauuuaguauguaga

SEQ ID NO: 2873 - RNA, 23 nt, Artificial Sequence
  source: /note="Description of Artificial Sequence: Synthetic oligonucleotide"
uaggagagagauuuaguauguag

SEQ ID NO: 2874 - RNA, 23 nt, Artificial Sequence
  source: /note="Description of Artificial Sequence: Synthetic oligonucleotide"
uaaggagagagauuuaguaugua

SEQ ID NO: 2875 - RNA, 23 nt, Artificial Sequence
  source: /note="Description of Artificial Sequence: Synthetic oligonucleotide"
uaaaggagagagauuuaguaugu

SEQ ID NO: 2876 - RNA, 23 nt, Artificial Sequence
  source: /note="Description of Artificial Sequence: Synthetic oligonucleotide"
uaaaaggagagagauuuaguaug

SEQ ID NO: 2877 - RNA, 23 nt, Artificial Sequence
  source: /note="Description of Artificial Sequence: Synthetic oligonucleotide"
uguagcaccaauaaauaaaugau

SEQ ID NO: 2878 - RNA, 23 nt, Artificial Sequence
  source: /note="Description of Artificial Sequence: Synthetic oligonucleotide"
uaguagcaccaauaaauaaauga

SEQ ID NO: 2879 - RNA, 23 nt, Artificial Sequence
  source: /note="Description of Artificial Sequence: Synthetic oligonucleotide"
ucaguagcaccaauaaauaaaug

SEQ ID NO: 2880 - RNA, 23 nt, Artificial Sequence
  source: /note="Description of Artificial Sequence: Synthetic oligonucleotide"
uacaguagcaccaauaaauaaau

SEQ ID NO: 2881 - RNA, 23 nt, Artificial Sequence
  source: /note="Description of Artificial Sequence: Synthetic oligonucleotide"
uaacaguagcaccaauaaauaaa

SEQ ID NO: 2882 - RNA, 23 nt, Artificial Sequence
  source: /note="Description of Artificial Sequence: Synthetic oligonucleotide"
uaaacaguagcaccaauaaauaa

SEQ ID NO: 2883 - RNA, 23 nt, Artificial Sequence
  source: /note="Description of Artificial Sequence: Synthetic oligonucleotide"
uauaaacaguagcaccaauaaau

SEQ ID NO: 2884 - RNA, 23 nt, Artificial Sequence
  source: /note="Description of Artificial Sequence: Synthetic oligonucleotide"
uggauaaacaguagcaccaauaa

SEQ ID NO: 2885 - RNA, 23 nt, Artificial Sequence
  source: /note="Description of Artificial Sequence: Synthetic oligonucleotide"
ucgugauguuaauaucuuuuccc

SEQ ID NO: 2886 - RNA, 23 nt, Artificial Sequence
  source: /note="Description of Artificial Sequence: Synthetic oligonucleotide"
uagagacaaagacgugauguuaa

SEQ ID NO: 2887 - RNA, 23 nt, Artificial Sequence
  source: /note="Description of Artificial Sequence: Synthetic oligonucleotide"
uuagagacaaagacgugauguua

SEQ ID NO: 2888 - RNA, 23 nt, Artificial Sequence
  source: /note="Description of Artificial Sequence: Synthetic oligonucleotide"
uacugcacuagagacaaagacgu

SEQ ID NO: 2889 - RNA, 23 nt, Artificial Sequence
  source: /note="Description of Artificial Sequence: Synthetic oligonucleotide"
uaacugcacuagagacaaagacg

SEQ ID NO: 2890 - RNA, 23 nt, Artificial Sequence
  source: /note="Description of Artificial Sequence: Synthetic oligonucleotide"
uaaacugcacuagagacaaagac

SEQ ID NO: 2891 - RNA, 23 nt, Artificial Sequence
  source: /note="Description of Artificial Sequence: Synthetic oligonucleotide"
uuauguacuacggaauaucucga

SEQ ID NO: 2892 - RNA, 23 nt, Artificial Sequence
  source: /note="Description of Artificial Sequence: Synthetic oligonucleotide"
uauauguacuacggaauaucucg

SEQ ID NO: 2893 - RNA, 23 nt, Artificial Sequence
  source: /note="Description of Artificial Sequence: Synthetic oligonucleotide"
uaauauguacuacggaauaucuc

SEQ ID NO: 2894 - RNA, 23 nt, Artificial Sequence
  source: /note="Description of Artificial Sequence: Synthetic oligonucleotide"
uauaucuguauuucuuugucguu

SEQ ID NO: 2895 - RNA, 23 nt, Artificial Sequence
  source: /note="Description of Artificial Sequence: Synthetic oligonucleotide"
uuauaucuguauuucuuugucgu

SEQ ID NO: 2896 - RNA, 23 nt, Artificial Sequence
  source: /note="Description of Artificial Sequence: Synthetic oligonucleotide"
uauauaucuguauuucuuugucg

SEQ ID NO: 2897 - RNA, 23 nt, Artificial Sequence
  source: /note="Description of Artificial Sequence: Synthetic oligonucleotide"
ugauauaucuguauuucuuuguc

SEQ ID NO: 2898 - RNA, 21 nt, Artificial Sequence
  source: /note="Description of Artificial Sequence: Synthetic oligonucleotide"
cggugcuggaauuugauauua

SEQ ID NO: 2899 - RNA, 21 nt, Artificial Sequence
  source: /note="Description of Artificial Sequence: Synthetic oligonucleotide"
ggugcuggaauuugauauuca

SEQ ID NO: 2900 - RNA, 21 nt, Artificial Sequence
  source: /note="Description of Artificial Sequence: Synthetic oligonucleotide"
ugcuggaauuugauauucaua

SEQ ID NO: 2901 - RNA, 21 nt, Artificial Sequence
  source: /note="Description of Artificial Sequence: Synthetic oligonucleotide"
gcuggaauuugauauucauua

SEQ ID NO: 2902 - RNA, 21 nt, Artificial Sequence
  source: /note="Description of Artificial Sequence: Synthetic oligonucleotide"
uggaauuugauauucauugaa

SEQ ID NO: 2903 - RNA, 21 nt, Artificial Sequence
  source: /note="Description of Artificial Sequence: Synthetic oligonucleotide"
ggaauuugauauucauugaua

SEQ ID NO: 2904 - RNA, 21 nt, Artificial Sequence
  source: /note="Description of Artificial Sequence: Synthetic oligonucleotide"
gaauuugauauucauugauca

SEQ ID NO: 2905 - RNA, 21 nt, Artificial Sequence
  source: /note="Description of Artificial Sequence: Synthetic oligonucleotide"
aauuugauauucauugaucca

SEQ ID NO: 2906 - RNA, 21 nt, Artificial Sequence
  source: /note="Description of Artificial Sequence: Synthetic oligonucleotide"
auuugauauucauugauccga

SEQ ID NO: 2907 - RNA, 21 nt, Artificial Sequence
  source: /note="Description of Artificial Sequence: Synthetic oligonucleotide"
uuugauauucauugauccgga

SEQ ID NO: 2908 - RNA, 21 nt, Artificial Sequence
  source: /note="Description of Artificial Sequence: Synthetic oligonucleotide"
uuuauuuuugcuugccauuca

SEQ ID NO: 2909 - RNA, 21 nt, Artificial Sequence
  source: /note="Description of Artificial Sequence: Synthetic oligonucleotide"
uuauuuuugcuugccauucca

SEQ ID NO: 2910 - RNA, 21 nt, Artificial Sequence
  source: /note="Description of Artificial Sequence: Synthetic oligonucleotide"
caaaucacuguggauuuugga

SEQ ID NO: 2911 - RNA, 21 nt, Artificial Sequence
  source: /note="Description of Artificial Sequence: Synthetic oligonucleotide"
aaaucacuguggauuuuggaa

SEQ ID NO: 2912 - RNA, 21 nt, Artificial Sequence
  source: /note="Description of Artificial Sequence: Synthetic oligonucleotide"
aaucacuguggauuuuggaaa

SEQ ID NO: 2913 - RNA, 21 nt, Artificial Sequence
  source: /note="Description of Artificial Sequence: Synthetic oligonucleotide"
aucacuguggauuuuggaaaa

SEQ ID NO: 2914 - RNA, 21 nt, Artificial Sequence
  source: /note="Description of Artificial Sequence: Synthetic oligonucleotide"
ucacuguggauuuuggaaaca

SEQ ID NO: 2915 - RNA, 21 nt, Artificial Sequence
  source: /note="Description of Artificial Sequence: Synthetic oligonucleotide"
cacuguggauuuuggaaacca

SEQ ID NO: 2916 - RNA, 21 nt, Artificial Sequence
  source: /note="Description of Artificial Sequence: Synthetic oligonucleotide"
acuguggauuuuggaaaccaa

SEQ ID NO: 2917 - RNA, 21 nt, Artificial Sequence
  source: /note="Description of Artificial Sequence: Synthetic oligonucleotide"
cuguggauuuuggaaaccaga

SEQ ID NO: 2918 - RNA, 21 nt, Artificial Sequence
  source: /note="Description of Artificial Sequence: Synthetic oligonucleotide"
uguggauuuuggaaaccagca

SEQ ID NO: 2919 - RNA, 21 nt, Artificial Sequence
  source: /note="Description of Artificial Sequence: Synthetic oligonucleotide"
guggauuuuggaaaccagcaa

SEQ ID NO: 2920 - RNA, 21 nt, Artificial Sequence
  source: /note="Description of Artificial Sequence: Synthetic oligonucleotide"
gauuuuggaaaccagcagaaa

SEQ ID NO: 2921 - RNA, 21 nt, Artificial Sequence
  source: /note="Description of Artificial Sequence: Synthetic oligonucleotide"
auuuuggaaaccagcagaaaa

SEQ ID NO: 2922 - RNA, 21 nt, Artificial Sequence
  source: /note="Description of Artificial Sequence: Synthetic oligonucleotide"
uuuuggaaaccagcagaaaga

SEQ ID NO: 2923 - RNA, 21 nt, Artificial Sequence
  source: /note="Description of Artificial Sequence: Synthetic oligonucleotide"
uuuggaaaccagcagaaagaa

SEQ ID NO: 2924 - RNA, 21 nt, Artificial Sequence
  source: /note="Description of Artificial Sequence: Synthetic oligonucleotide"
ggaaaccagcagaaagaggaa

SEQ ID NO: 2925 - RNA, 21 nt, Artificial Sequence
  source: /note="Description of Artificial Sequence: Synthetic oligonucleotide"
aaaccagcagaaagaggaaaa

SEQ ID NO: 2926 - RNA, 21 nt, Artificial Sequence
  source: /note="Description of Artificial Sequence: Synthetic oligonucleotide"
aaccagcagaaagaggaaaga

SEQ ID NO: 2927 - RNA, 21 nt, Artificial Sequence
  source: /note="Description of Artificial Sequence: Synthetic oligonucleotide"
accagcagaaagaggaaagaa

SEQ ID NO: 2928 - RNA, 21 nt, Artificial Sequence
  source: /note="Description of Artificial Sequence: Synthetic oligonucleotide"
ccagcagaaagaggaaagaga

SEQ ID NO: 2929 - RNA, 21 nt, Artificial Sequence
  source: /note="Description of Artificial Sequence: Synthetic oligonucleotide"
cagcagaaagaggaaagagga

SEQ ID NO: 2930 - RNA, 21 nt, Artificial Sequence
  source: /note="Description of Artificial Sequence: Synthetic oligonucleotide"
agcagaaagaggaaagaggua

SEQ ID NO: 2931 - RNA, 21 nt, Artificial Sequence
  source: /note="Description of Artificial Sequence: Synthetic oligonucleotide"
gcagaaagaggaaagagguaa

SEQ ID NO: 2932 - RNA, 21 nt, Artificial Sequence
  source: /note="Description of Artificial Sequence: Synthetic oligonucleotide"
cagaaagaggaaagagguaga

SEQ ID NO: 2933 - RNA, 21 nt, Artificial Sequence
  source: /note="Description of Artificial Sequence: Synthetic oligonucleotide"
aaagaggaaagagguagcaaa

SEQ ID NO: 2934 - RNA, 21 nt, Artificial Sequence
  source: /note="Description of Artificial Sequence: Synthetic oligonucleotide"
aagaggaaagagguagcaaga

SEQ ID NO: 2935 - RNA, 21 nt, Artificial Sequence
  source: /note="Description of Artificial Sequence: Synthetic oligonucleotide"
agaggaaagagguagcaagaa

SEQ ID NO: 2936 - RNA, 21 nt, Artificial Sequence
  source: /note="Description of Artificial Sequence: Synthetic oligonucleotide"
gaggaaagagguagcaagaga

SEQ ID NO: 2937 - RNA, 21 nt, Artificial Sequence
  source: /note="Description of Artificial Sequence: Synthetic oligonucleotide"
ggaaagagguagcaagagcua

SEQ ID NO: 2938 - RNA, 21 nt, Artificial Sequence
  source: /note="Description of Artificial Sequence: Synthetic oligonucleotide"
agguagcaagagcuccagaga

SEQ ID NO: 2939 - RNA, 21 nt, Artificial Sequence
  source: /note="Description of Artificial Sequence: Synthetic oligonucleotide"
uccagagagaagucgaggaaa

SEQ ID NO: 2940 - RNA, 21 nt, Artificial Sequence
  source: /note="Description of Artificial Sequence: Synthetic oligonucleotide"
ccagagagaagucgaggaaga

SEQ ID NO: 2941 - RNA, 21 nt, Artificial Sequence
  source: /note="Description of Artificial Sequence: Synthetic oligonucleotide"
cagagagaagucgaggaagaa

SEQ ID NO: 2942 - RNA, 21 nt, Artificial Sequence
  source: /note="Description of Artificial Sequence: Synthetic oligonucleotide"
agagaagucgaggaagagaga

SEQ ID NO: 2943 - RNA, 21 nt, Artificial Sequence
  source: /note="Description of Artificial Sequence: Synthetic oligonucleotide"
gagaagucgaggaagagagaa

SEQ ID NO: 2944 - RNA, 21 nt, Artificial Sequence
  source: /note="Description of Artificial Sequence: Synthetic oligonucleotide"
gaagucgaggaagagagagaa

SEQ ID NO: 2945 - RNA, 21 nt, Artificial Sequence
  source: /note="Description of Artificial Sequence: Synthetic oligonucleotide"
agugagugaccugcuuuugga

SEQ ID NO: 2946 - RNA, 21 nt, Artificial Sequence
  source: /note="Description of Artificial Sequence: Synthetic oligonucleotide"
ggcgucgcacugaaacuuuua

SEQ ID NO: 2947 - RNA, 21 nt, Artificial Sequence
  source: /note="Description of Artificial Sequence: Synthetic oligonucleotide"
gucgcacugaaacuuuucgua

SEQ ID NO: 2948 - RNA, 21 nt, Artificial Sequence
  source: /note="Description of Artificial Sequence: Synthetic oligonucleotide"
ucgcacugaaacuuuucguca

SEQ ID NO: 2949 - RNA, 21 nt, Artificial Sequence
  source: /note="Description of Artificial Sequence: Synthetic oligonucleotide"
cacugaaacuuuucguccaaa

SEQ ID NO: 2950 - RNA, 21 nt, Artificial Sequence
  source: /note="Description of Artificial Sequence: Synthetic oligonucleotide"
acugaaacuuuucguccaaca

SEQ ID NO: 2951 - RNA, 21 nt, Artificial Sequence
  source: /note="Description of Artificial Sequence: Synthetic oligonucleotide"
ugaaacuuuucguccaacuua

SEQ ID NO: 2952 - RNA, 21 nt, Artificial Sequence
  source: /note="Description of Artificial Sequence: Synthetic oligonucleotide"
aacuuuucguccaacuucuga

SEQ ID NO: 2953 - RNA, 21 nt, Artificial Sequence
  source: /note="Description of Artificial Sequence: Synthetic oligonucleotide"
cugggcuguucucgcuucgga

SEQ ID NO: 2954 - RNA, 21 nt, Artificial Sequence
  source: /note="Description of Artificial Sequence: Synthetic oligonucleotide"
ugggcuguucucgcuucggaa

SEQ ID NO: 2955 - RNA, 21 nt, Artificial Sequence
  source: /note="Description of Artificial Sequence: Synthetic oligonucleotide"
gggcuguucucgcuucggaga

SEQ ID NO: 2956 - RNA, 21 nt, Artificial Sequence
  source: /note="Description of Artificial Sequence: Synthetic oligonucleotide"
gcuguucucgcuucggaggaa

SEQ ID NO: 2957 - RNA, 21 nt, Artificial Sequence
  source: /note="Description of Artificial Sequence: Synthetic oligonucleotide"
gccgcgagaagugcuagcuca

SEQ ID NO: 2958 - RNA, 21 nt, Artificial Sequence
  source: /note="Description of Artificial Sequence: Synthetic oligonucleotide"
ccgcgagaagugcuagcucga

SEQ ID NO: 2959 - RNA, 21 nt, Artificial Sequence
  source: /note="Description of Artificial Sequence: Synthetic oligonucleotide"
gccuccgaaaccaugaacuua

SEQ ID NO: 2960 - RNA, 21 nt, Artificial Sequence
  source: /note="Description of Artificial Sequence: Synthetic oligonucleotide"
aaggaggagggcagaaucaua

SEQ ID NO: 2961 - RNA, 21 nt, Artificial Sequence
  source: /note="Description of Artificial Sequence: Synthetic oligonucleotide"
ggcagaaucaucacgaaguga

SEQ ID NO: 2962 - RNA, 21 nt, Artificial Sequence
  source: /note="Description of Artificial Sequence: Synthetic oligonucleotide"
aaucaucacgaaguggugaaa

SEQ ID NO: 2963 - RNA, 21 nt, Artificial Sequence
  source: /note="Description of Artificial Sequence: Synthetic oligonucleotide"
aucaucacgaaguggugaaga

SEQ ID NO: 2964 - RNA, 21 nt, Artificial Sequence
  source: /note="Description of Artificial Sequence: Synthetic oligonucleotide"
ucaucacgaaguggugaagua

SEQ ID NO: 2965 - RNA, 21 nt, Artificial Sequence
  source: /note="Description of Artificial Sequence: Synthetic oligonucleotide"
caucacgaaguggugaaguua

SEQ ID NO: 2966 - RNA, 21 nt, Artificial Sequence
  source: /note="Description of Artificial Sequence: Synthetic oligonucleotide"
ucacgaaguggugaaguucaa

SEQ ID NO: 2967 - RNA, 21 nt, Artificial Sequence
  source: /note="Description of Artificial Sequence: Synthetic oligonucleotide"
aaguggugaaguucauggaua

SEQ ID NO: 2968 - RNA, 21 nt, Artificial Sequence
  source: /note="Description of Artificial Sequence: Synthetic oligonucleotide"
aguggugaaguucauggauga

SEQ ID NO: 2969 - RNA, 21 nt, Artificial Sequence
  source: /note="Description of Artificial Sequence: Synthetic oligonucleotide"
guggugaaguucauggaugua

SEQ ID NO: 2970 - RNA, 21 nt, Artificial Sequence
  source: /note="Description of Artificial Sequence: Synthetic oligonucleotide"
ggugaaguucauggaugucua

SEQ ID NO: 2971 - RNA, 21 nt, Artificial Sequence
  source: /note="Description of Artificial Sequence: Synthetic oligonucleotide"
gugaaguucauggaugucuaa

SEQ ID NO: 2972 - RNA, 21 nt, Artificial Sequence
  source: /note="Description of Artificial Sequence: Synthetic oligonucleotide"
ugaaguucauggaugucuaua

SEQ ID NO: 2973 - RNA, 21 nt, Artificial Sequence
  source: /note="Description of Artificial Sequence: Synthetic oligonucleotide"
aaguucauggaugucuaucaa

SEQ ID NO: 2974 - RNA, 21 nt, Artificial Sequence
  source: /note="Description of Artificial Sequence: Synthetic oligonucleotide"
aguucauggaugucuaucaga

SEQ ID NO: 2975 - RNA, 21 nt, Artificial Sequence
  source: /note="Description of Artificial Sequence: Synthetic oligonucleotide"
uucauggaugucuaucagcga

SEQ ID NO: 2976 - RNA, 21 nt, Artificial Sequence
  source: /note="Description of Artificial Sequence: Synthetic oligonucleotide"
guggacaucuuccaggaguaa

SEQ ID NO: 2977 - RNA, 21 nt, Artificial Sequence
  source: /note="Description of Artificial Sequence: Synthetic oligonucleotide"
ucgaguacaucuucaagccaa

SEQ ID NO: 2978 - RNA, 21 nt, Artificial Sequence
  source: /note="Description of Artificial Sequence: Synthetic oligonucleotide"
cgaguacaucuucaagccaua

SEQ ID NO: 2979 - RNA, 21 nt, Artificial Sequence
  source: /note="Description of Artificial Sequence: Synthetic oligonucleotide"
gaguacaucuucaagccauca

SEQ ID NO: 2980 - RNA, 21 nt, Artificial Sequence
  source: /note="Description of Artificial Sequence: Synthetic oligonucleotide"
guacaucuucaagccauccua

SEQ ID NO: 2981 - RNA, 21 nt, Artificial Sequence
  source: /note="Description of Artificial Sequence: Synthetic oligonucleotide"
ccaacaucaccaugcagauua

SEQ ID NO: 2982 - RNA, 21 nt, Artificial Sequence
  source: /note="Description of Artificial Sequence: Synthetic oligonucleotide"
caacaucaccaugcagauuaa

SEQ ID NO: 2983 - RNA, 21 nt, Artificial Sequence
  source: /note="Description of Artificial Sequence: Synthetic oligonucleotide"
acaucaccaugcagauuauga

SEQ ID NO: 2984 - RNA, 21 nt, Artificial Sequence
  source: /note="Description of Artificial Sequence: Synthetic oligonucleotide"
caucaccaugcagauuaugca

SEQ ID NO: 2985 - RNA, 21 nt, Artificial Sequence
  source: /note="Description of Artificial Sequence: Synthetic oligonucleotide"
accaugcagauuaugcggaua

SEQ ID NO: 2986 - RNA, 21 nt, Artificial Sequence
  source: /note="Description of Artificial Sequence: Synthetic oligonucleotide"
augcagauuaugcggaucaaa

SEQ ID NO: 2987 - RNA, 21 nt, Artificial Sequence
  source: /note="Description of Artificial Sequence: Synthetic oligonucleotide"
ugcagauuaugcggaucaaaa

SEQ ID NO: 2988 - RNA, 21 nt, Artificial Sequence
  source: /note="Description of Artificial Sequence: Synthetic oligonucleotide"
gcagauuaugcggaucaaaca

SEQ ID NO: 2989 - RNA, 21 nt, Artificial Sequence
  source: /note="Description of Artificial Sequence: Synthetic oligonucleotide"
gauuaugcggaucaaaccuca

SEQ ID NO: 2990 - RNA, 21 nt, Artificial Sequence
  source: /note="Description of Artificial Sequence: Synthetic oligonucleotide"
auuaugcggaucaaaccucaa

SEQ ID NO: 2991 - RNA, 21 nt, Artificial Sequence
  source: /note="Description of Artificial Sequence: Synthetic oligonucleotide"
cggaucaaaccucaccaagga

SEQ ID NO: 2992 - RNA, 21 nt, Artificial Sequence
  source: /note="Description of Artificial Sequence: Synthetic oligonucleotide"
ggagagaugagcuuccuacaa

SEQ ID NO: 2993 - RNA, 21 nt, Artificial Sequence
  source: /note="Description of Artificial Sequence: Synthetic oligonucleotide"
gagaugagcuuccuacagcaa

SEQ ID NO: 2994 - RNA, 21 nt, Artificial Sequence
  source: /note="Description of Artificial Sequence: Synthetic oligonucleotide"
gaugagcuuccuacagcacaa

SEQ ID NO: 2995 - RNA, 21 nt, Artificial Sequence
  source: /note="Description of Artificial Sequence: Synthetic oligonucleotide"
augagcuuccuacagcacaaa

SEQ ID NO: 2996 - RNA, 21 nt, Artificial Sequence
  source: /note="Description of Artificial Sequence: Synthetic oligonucleotide"
gagcuuccuacagcacaacaa

SEQ ID NO: 2997 - RNA, 21 nt, Artificial Sequence
  source: /note="Description of Artificial Sequence: Synthetic oligonucleotide"
agcuuccuacagcacaacaaa

SEQ ID NO: 2998 - RNA, 21 nt, Artificial Sequence
  source: /note="Description of Artificial Sequence: Synthetic oligonucleotide"
gcuuccuacagcacaacaaaa

SEQ ID NO: 2999 - RNA, 21 nt, Artificial Sequence
  source: /note="Description of Artificial Sequence: Synthetic oligonucleotide"
cuuccuacagcacaacaaaua

SEQ ID NO: 3000 - RNA, 21 nt, Artificial Sequence
  source: /note="Description of Artificial Sequence: Synthetic oligonucleotide"
uccuacagcacaacaaaugua

SEQ ID NO: 3001 - RNA, 21 nt, Artificial Sequence
  source: /note="Description of Artificial Sequence: Synthetic oligonucleotide"
cuacagcacaacaaaugugaa

SEQ ID NO: 3002 - RNA, 21 nt, Artificial Sequence
  source: /note="Description of Artificial Sequence: Synthetic oligonucleotide"
uacagcacaacaaaugugaaa

SEQ ID NO: 3003 - RNA, 21 nt, Artificial Sequence
  source: /note="Description of Artificial Sequence: Synthetic oligonucleotide"
agcacaacaaaugugaaugca

SEQ ID NO: 3004 - RNA, 21 nt, Artificial Sequence
  source: /note="Description of Artificial Sequence: Synthetic oligonucleotide"
gcacaacaaaugugaaugcaa

SEQ ID NO: 3005 - RNA, 21 nt, Artificial Sequence
  source: /note="Description of Artificial Sequence: Synthetic oligonucleotide"
cucaccaggaaagacugauaa

SEQ ID NO: 3006 - RNA, 21 nt, Artificial Sequence
  source: /note="Description of Artificial Sequence: Synthetic oligonucleotide"
ucaccaggaaagacugauaca

SEQ ID NO: 3007 - RNA, 21 nt, Artificial Sequence
  source: /note="Description of Artificial Sequence: Synthetic oligonucleotide"
caccaggaaagacugauacaa

SEQ ID NO: 3008 - RNA, 21 nt, Artificial Sequence
  source: /note="Description of Artificial Sequence: Synthetic oligonucleotide"
accaggaaagacugauacaga

SEQ ID NO: 3009 - RNA, 21 nt, Artificial Sequence
  source: /note="Description of Artificial Sequence: Synthetic oligonucleotide"
ccaggaaagacugauacagaa

SEQ ID NO: 3010 - RNA, 21 nt, Artificial Sequence
  source: /note="Description of Artificial Sequence: Synthetic oligonucleotide"
caggaaagacugauacagaaa

SEQ ID NO: 3011 - RNA, 21 nt, Artificial Sequence
  source: /note="Description of Artificial Sequence: Synthetic oligonucleotide"
aggaaagacugauacagaaca

SEQ ID NO: 3012 - RNA, 21 nt, Artificial Sequence
  source: /note="Description of Artificial Sequence: Synthetic oligonucleotide"
ggaaagacugauacagaacga

SEQ ID NO: 3013 - RNA, 21 nt, Artificial Sequence
  source: /note="Description of Artificial Sequence: Synthetic oligonucleotide"
gaaagacugauacagaacgaa

SEQ ID NO: 3014 - RNA, 21 nt, Artificial Sequence
  source: /note="Description of Artificial Sequence: Synthetic oligonucleotide"
aaagacugauacagaacgaua

SEQ ID NO: 3015 - RNA, 21 nt, Artificial Sequence
  source: /note="Description of Artificial Sequence: Synthetic oligonucleotide"
aagacugauacagaacgauca

SEQ ID NO: 3016 - RNA, 21 nt, Artificial Sequence
  source: /note="Description of Artificial Sequence: Synthetic oligonucleotide"
agacugauacagaacgaucga

SEQ ID NO: 3017 - RNA, 21 nt, Artificial Sequence
  source: /note="Description of Artificial Sequence: Synthetic oligonucleotide"
gacugauacagaacgaucgaa

SEQ ID NO: 3018 - RNA, 21 nt, Artificial Sequence
  source: /note="Description of Artificial Sequence: Synthetic oligonucleotide"
acugauacagaacgaucgaua

SEQ ID NO: 3019 - RNA, 21 nt, Artificial Sequence
  source: /note="Description of Artificial Sequence: Synthetic oligonucleotide"
cugauacagaacgaucgauaa

SEQ ID NO: 3020 - RNA, 21 nt, Artificial Sequence
  source: /note="Description of Artificial Sequence: Synthetic oligonucleotide"
ugauacagaacgaucgauaca

SEQ ID NO: 3021 - RNA, 21 nt, Artificial Sequence
  source: /note="Description of Artificial Sequence: Synthetic oligonucleotide"
gauacagaacgaucgauacaa

SEQ ID NO: 3022 - RNA, 21 nt, Artificial Sequence
  source: /note="Description of Artificial Sequence: Synthetic oligonucleotide"
auacagaacgaucgauacaga

SEQ ID NO: 3023 - RNA, 21 nt, Artificial Sequence
  source: /note="Description of Artificial Sequence: Synthetic oligonucleotide"
uacagaacgaucgauacagaa

SEQ ID NO: 3024 - RNA, 21 nt, Artificial Sequence
  source: /note="Description of Artificial Sequence: Synthetic oligonucleotide"
acagaacgaucgauacagaaa

SEQ ID NO: 3025 - RNA, 21 nt, Artificial Sequence
  source: /note="Description of Artificial Sequence: Synthetic oligonucleotide"
cagaacgaucgauacagaaaa

SEQ ID NO: 3026 - RNA, 21 nt, Artificial Sequence
  source: /note="Description of Artificial Sequence: Synthetic oligonucleotide"
agaacgaucgauacagaaaca

SEQ ID NO: 3027 - RNA, 21 nt, Artificial Sequence
  source: /note="Description of Artificial Sequence: Synthetic oligonucleotide"
gaacgaucgauacagaaacca

SEQ ID NO: 3028 - RNA, 21 nt, Artificial Sequence
  source: /note="Description of Artificial Sequence: Synthetic oligonucleotide"
aacgaucgauacagaaaccaa

SEQ ID NO: 3029 - RNA, 21 nt, Artificial Sequence
  source: /note="Description of Artificial Sequence: Synthetic oligonucleotide"
acgaucgauacagaaaccaca

SEQ ID NO: 3030 - RNA, 21 nt, Artificial Sequence
  source: /note="Description of Artificial Sequence: Synthetic oligonucleotide"
cgaucgauacagaaaccacga

SEQ ID NO: 3031 - RNA, 21 nt, Artificial Sequence
  source: /note="Description of Artificial Sequence: Synthetic oligonucleotide"
caccaucaccaucgacagaaa

SEQ ID NO: 3032 - RNA, 21 nt, Artificial Sequence
  source: /note="Description of Artificial Sequence: Synthetic oligonucleotide"
caucaccaucgacagaacaga

SEQ ID NO: 3033 - RNA, 21 nt, Artificial Sequence
  source: /note="Description of Artificial Sequence: Synthetic oligonucleotide"
ucaccaucgacagaacaguca

SEQ ID NO: 3034 - RNA, 21 nt, Artificial Sequence
  source: /note="Description of Artificial Sequence: Synthetic oligonucleotide"
caccaucgacagaacagucca

SEQ ID NO: 3035 - RNA, 21 nt, Artificial Sequence
  source: /note="Description of Artificial Sequence: Synthetic oligonucleotide"
accaucgacagaacaguccua

SEQ ID NO: 3036 - RNA, 21 nt, Artificial Sequence
  source: /note="Description of Artificial Sequence: Synthetic oligonucleotide"
ccaucgacagaacaguccuua

SEQ ID NO: 3037 - RNA, 21 nt, Artificial Sequence
  source: /note="Description of Artificial Sequence: Synthetic oligonucleotide"
caucgacagaacaguccuuaa

SEQ ID NO: 3038 - RNA, 21 nt, Artificial Sequence
  source: /note="Description of Artificial Sequence: Synthetic oligonucleotide"
aucgacagaacaguccuuaaa

SEQ ID NO: 3039 - RNA, 21 nt, Artificial Sequence
  source: /note="Description of Artificial Sequence: Synthetic oligonucleotide"
ucgacagaacaguccuuaaua

SEQ ID NO: 3040 - RNA, 21 nt, Artificial Sequence
  source: /note="Description of Artificial Sequence: Synthetic oligonucleotide"
cgacagaacaguccuuaauca

SEQ ID NO: 3041 - RNA, 21 nt, Artificial Sequence
  source: /note="Description of Artificial Sequence: Synthetic oligonucleotide"
gacagaacaguccuuaaucca

SEQ ID NO: 3042 - RNA, 21 nt, Artificial Sequence
  source: /note="Description of Artificial Sequence: Synthetic oligonucleotide"
acagaacaguccuuaauccaa

SEQ ID NO: 3043 - RNA, 21 nt, Artificial Sequence
  source: /note="Description of Artificial Sequence: Synthetic oligonucleotide"
agaacaguccuuaauccagaa

SEQ ID NO: 3044 - RNA, 21 nt, Artificial Sequence
  source: /note="Description of Artificial Sequence: Synthetic oligonucleotide"
gaacaguccuuaauccagaaa

SEQ ID NO: 3045 - RNA, 21 nt, Artificial Sequence
  source: /note="Description of Artificial Sequence: Synthetic oligonucleotide"
aacaguccuuaauccagaaaa

SEQ ID NO: 3046 - RNA, 21 nt, Artificial Sequence
  source: /note="Description of Artificial Sequence: Synthetic oligonucleotide"
acaguccuuaauccagaaaca

SEQ ID NO: 3047 - RNA, 21 nt, Artificial Sequence
  source: /note="Description of Artificial Sequence: Synthetic oligonucleotide"
caguccuuaauccagaaacca

SEQ ID NO: 3048 - RNA, 21 nt, Artificial Sequence
  source: /note="Description of Artificial Sequence: Synthetic oligonucleotide"
aguccuuaauccagaaaccua

SEQ ID NO: 3049 - RNA, 21 nt, Artificial Sequence
  source: /note="Description of Artificial Sequence: Synthetic oligonucleotide"
guccuuaauccagaaaccuga

SEQ ID NO: 3050 - RNA, 21 nt, Artificial Sequence
  source: /note="Description of Artificial Sequence: Synthetic oligonucleotide"
uccuuaauccagaaaccugaa

SEQ ID NO: 3051 - RNA, 21 nt, Artificial Sequence
  source: /note="Description of Artificial Sequence: Synthetic oligonucleotide"
ccuuaauccagaaaccugaaa

SEQ ID NO: 3052 - RNA, 21 nt, Artificial Sequence
  source: /note="Description of Artificial Sequence: Synthetic oligonucleotide"
cuuaauccagaaaccugaaaa

SEQ ID NO: 3053 - RNA, 21 nt, Artificial Sequence
  source: /note="Description of Artificial Sequence: Synthetic oligonucleotide"
uuaauccagaaaccugaaaua

SEQ ID NO: 3054 - RNA, 21 nt, Artificial Sequence
  source: /note="Description of Artificial Sequence: Synthetic oligonucleotide"
cagaaaccugaaaugaaggaa

SEQ ID NO: 3055 - RNA, 21 nt, Artificial Sequence
  source: /note="Description of Artificial Sequence: Synthetic oligonucleotide"
agaaaccugaaaugaaggaaa

SEQ ID NO: 3056 - RNA, 21 nt, Artificial Sequence
  source: /note="Description of Artificial Sequence: Synthetic oligonucleotide"
gaaaccugaaaugaaggaaga

SEQ ID NO: 3057 - RNA, 21 nt, Artificial Sequence
  source: /note="Description of Artificial Sequence: Synthetic oligonucleotide"
aaaccugaaaugaaggaagaa

SEQ ID NO: 3058 - RNA, 21 nt, Artificial Sequence
  source: /note="Description of Artificial Sequence: Synthetic oligonucleotide"
aaccugaaaugaaggaagaga

SEQ ID NO: 3059 - RNA, 21 nt, Artificial Sequence
  source: /note="Description of Artificial Sequence: Synthetic oligonucleotide"
ccugaaaugaaggaagaggaa

SEQ ID NO: 3060 - RNA, 21 nt, Artificial Sequence
  source: /note="Description of Artificial Sequence: Synthetic oligonucleotide"
augaaggaagaggagacucua

SEQ ID NO: 3061 - RNA, 21 nt, Artificial Sequence
  source: /note="Description of Artificial Sequence: Synthetic oligonucleotide"
ucccucuuggaauuggauuca

SEQ ID NO: 3062 - RNA, 21 nt, Artificial Sequence
  source: /note="Description of Artificial Sequence: Synthetic oligonucleotide"
ccucuuggaauuggauucgca

SEQ ID NO: 3063 - RNA, 21 nt, Artificial Sequence
  source: /note="Description of Artificial Sequence: Synthetic oligonucleotide"
cucuuggaauuggauucgcca

SEQ ID NO: 3064 - RNA, 21 nt, Artificial Sequence
  source: /note="Description of Artificial Sequence: Synthetic oligonucleotide"
uuggaauuggauucgccauua

SEQ ID NO: 3065 - RNA, 21 nt, Artificial Sequence
  source: /note="Description of Artificial Sequence: Synthetic oligonucleotide"
uggaauuggauucgccauuua

SEQ ID NO: 3066 - RNA, 21 nt, Artificial Sequence
  source: /note="Description of Artificial Sequence: Synthetic oligonucleotide"
ggaauuggauucgccauuuua

SEQ ID NO: 3067 - RNA, 21 nt, Artificial Sequence
  source: /note="Description of Artificial Sequence: Synthetic oligonucleotide"
gaauuggauucgccauuuuaa

SEQ ID NO: 3068 - RNA, 21 nt, Artificial Sequence
  source: /note="Description of Artificial Sequence: Synthetic oligonucleotide"
aauuggauucgccauuuuaua

SEQ ID NO: 3069 - RNA, 21 nt, Artificial Sequence
  source: /note="Description of Artificial Sequence: Synthetic oligonucleotide"
auuggauucgccauuuuauua

SEQ ID NO: 3070 - RNA, 21 nt, Artificial Sequence
  source: /note="Description of Artificial Sequence: Synthetic oligonucleotide"
uuggauucgccauuuuauuua

SEQ ID NO: 3071 - RNA, 21 nt, Artificial Sequence
  source: /note="Description of Artificial Sequence: Synthetic oligonucleotide"
uggauucgccauuuuauuuua

SEQ ID NO: 3072 - RNA, 21 nt, Artificial Sequence
  source: /note="Description of Artificial Sequence: Synthetic oligonucleotide"
ggauucgccauuuuauuuuua

SEQ ID NO: 3073 - RNA, 21 nt, Artificial Sequence
  source: /note="Description of Artificial Sequence: Synthetic oligonucleotide"
gauucgccauuuuauuuuuca

SEQ ID NO: 3074 - RNA, 21 nt, Artificial Sequence
  source: /note="Description of Artificial Sequence: Synthetic oligonucleotide"
ucgccauuuuauuuuucuuga

SEQ ID NO: 3075 - RNA, 21 nt, Artificial Sequence
  source: /note="Description of Artificial Sequence: Synthetic oligonucleotide"
cgccauuuuauuuuucuugca

SEQ ID NO: 3076 - RNA, 21 nt, Artificial Sequence
  source: /note="Description of Artificial Sequence: Synthetic oligonucleotide"
gccauuuuauuuuucuugcua

SEQ ID NO: 3077 - RNA, 21 nt, Artificial Sequence
  source: /note="Description of Artificial Sequence: Synthetic oligonucleotide"
ccauuuuauuuuucuugcuga

SEQ ID NO: 3078 - RNA, 21 nt, Artificial Sequence
  source: /note="Description of Artificial Sequence: Synthetic oligonucleotide"
cauuuuauuuuucuugcugca

SEQ ID NO: 3079 - RNA, 21 nt, Artificial Sequence
  source: /note="Description of Artificial Sequence: Synthetic oligonucleotide"
auuuuauuuuucuugcugcua

SEQ ID NO: 3080 - RNA, 21 nt, Artificial Sequence
  source: /note="Description of Artificial Sequence: Synthetic oligonucleotide"
uuuuauuuuucuugcugcuaa

SEQ ID NO: 3081 - RNA, 21 nt, Artificial Sequence
  source: /note="Description of Artificial Sequence: Synthetic oligonucleotide"
uuucuugcugcuaaaucacca

SEQ ID NO: 3082 - RNA, 21 nt, Artificial Sequence
  source: /note="Description of Artificial Sequence: Synthetic oligonucleotide"
ucaccgagcccggaagauuaa

SEQ ID NO: 3083 - RNA, 21 nt, Artificial Sequence
  source: /note="Description of Artificial Sequence: Synthetic oligonucleotide"
gcccggaagauuagagaguua

SEQ ID NO: 3084 - RNA, 21 nt, Artificial Sequence
  source: /note="Description of Artificial Sequence: Synthetic oligonucleotide"
cccggaagauuagagaguuua

SEQ ID NO: 3085 - RNA, 21 nt, Artificial Sequence
  source: /note="Description of Artificial Sequence: Synthetic oligonucleotide"
cggaagauuagagaguuuuaa

SEQ ID NO: 3086 - RNA, 21 nt, Artificial Sequence
  source: /note="Description of Artificial Sequence: Synthetic oligonucleotide"
ggaagauuagagaguuuuaua

SEQ ID NO: 3087 - RNA, 21 nt, Artificial Sequence
  source: /note="Description of Artificial Sequence: Synthetic oligonucleotide"
gaagauuagagaguuuuauua

SEQ ID NO: 3088 - RNA, 21 nt, Artificial Sequence
  source: /note="Description of Artificial Sequence: Synthetic oligonucleotide"
aagauuagagaguuuuauuua

SEQ ID NO: 3089 - RNA, 21 nt, Artificial Sequence
  source: /note="Description of Artificial Sequence: Synthetic oligonucleotide"
agauuagagaguuuuauuuca

SEQ ID NO: 3090 - RNA, 21 nt, Artificial Sequence
  source: /note="Description of Artificial Sequence: Synthetic oligonucleotide"
auuagagaguuuuauuucuga

SEQ ID NO: 3091 - RNA, 21 nt, Artificial Sequence
  source: /note="Description of Artificial Sequence: Synthetic oligonucleotide"
uuagagaguuuuauuucugga

SEQ ID NO: 3092 - RNA, 21 nt, Artificial Sequence
  source: /note="Description of Artificial Sequence: Synthetic oligonucleotide"
uagagaguuuuauuucuggga

SEQ ID NO: 3093 - RNA, 21 nt, Artificial Sequence
  source: /note="Description of Artificial Sequence: Synthetic oligonucleotide"
agagaguuuuauuucugggaa

SEQ ID NO: 3094 - RNA, 21 nt, Artificial Sequence
  source: /note="Description of Artificial Sequence: Synthetic oligonucleotide"
gagaguuuuauuucugggaua

SEQ ID NO: 3095 - RNA, 21 nt, Artificial Sequence
  source: /note="Description of Artificial Sequence: Synthetic oligonucleotide"
agaguuuuauuucugggauua

SEQ ID NO: 3096 - RNA, 21 nt, Artificial Sequence
  source: /note="Description of Artificial Sequence: Synthetic oligonucleotide"
gaguuuuauuucugggauuca

SEQ ID NO: 3097 - RNA, 21 nt, Artificial Sequence
  source: /note="Description of Artificial Sequence: Synthetic oligonucleotide"
aguuuuauuucugggauucca

SEQ ID NO: 3098 - RNA, 21 nt, Artificial Sequence
  source: /note="Description of Artificial Sequence: Synthetic oligonucleotide"
guuuuauuucugggauuccua

SEQ ID NO: 3099 - RNA, 21 nt, Artificial Sequence
  source: /note="Description of Artificial Sequence: Synthetic oligonucleotide"
uuuuauuucugggauuccuga

SEQ ID NO: 3100 - RNA, 21 nt, Artificial Sequence
  source: /note="Description of Artificial Sequence: Synthetic oligonucleotide"
uuuauuucugggauuccugua

SEQ ID NO: 3101 - RNA, 21 nt, Artificial Sequence
  source: /note="Description of Artificial Sequence: Synthetic oligonucleotide"
uuauuucugggauuccuguaa

SEQ ID NO: 3102 - RNA, 21 nt, Artificial Sequence
  source: /note="Description of Artificial Sequence: Synthetic oligonucleotide"
uauuucugggauuccuguaga

SEQ ID NO: 3103 - RNA, 21 nt, Artificial Sequence
  source: /note="Description of Artificial Sequence: Synthetic oligonucleotide"
auuucugggauuccuguagaa

SEQ ID NO: 3104 - RNA, 21 nt, Artificial Sequence
  source: /note="Description of Artificial Sequence: Synthetic oligonucleotide"
uuucugggauuccuguagaca

SEQ ID NO: 3105 - RNA, 21 nt, Artificial Sequence
  source: /note="Description of Artificial Sequence: Synthetic oligonucleotide"
ucugggauuccuguagacaca

SEQ ID NO: 3106 - RNA, 21 nt, Artificial Sequence
  source: /note="Description of Artificial Sequence: Synthetic oligonucleotide"
cugggauuccuguagacacaa

SEQ ID NO: 3107 - RNA, 21 nt, Artificial Sequence
  source: /note="Description of Artificial Sequence: Synthetic oligonucleotide"
ugggauuccuguagacacaca

SEQ ID NO: 3108 - RNA, 21 nt, Artificial Sequence
  source: /note="Description of Artificial Sequence: Synthetic oligonucleotide"
gggauuccuguagacacacca

SEQ ID NO: 3109 - RNA, 21 nt, Artificial Sequence
  source: /note="Description of Artificial Sequence: Synthetic oligonucleotide"
acacacccacccacauacaua

SEQ ID NO: 3110 - RNA, 21 nt, Artificial Sequence
  source: /note="Description of Artificial Sequence: Synthetic oligonucleotide"
acccacccacauacauacaua

SEQ ID NO: 3111 - RNA, 21 nt, Artificial Sequence
  source: /note="Description of Artificial Sequence: Synthetic oligonucleotide"
cccacccacauacauacauua

SEQ ID NO: 3112 - RNA, 21 nt, Artificial Sequence
  source: /note="Description of Artificial Sequence: Synthetic oligonucleotide"
ccacccacauacauacauuua

SEQ ID NO: 3113 - RNA, 21 nt, Artificial Sequence
  source: /note="Description of Artificial Sequence: Synthetic oligonucleotide"
cacccacauacauacauuuaa

SEQ ID NO: 3114 - RNA, 21 nt, Artificial Sequence
  source: /note="Description of Artificial Sequence: Synthetic oligonucleotide"
ccacauacauacauuuauaua

SEQ ID NO: 3115 - RNA, 21 nt, Artificial Sequence
  source: /note="Description of Artificial Sequence: Synthetic oligonucleotide"
cacauacauacauuuauauaa

SEQ ID NO: 3116 - RNA, 21 nt, Artificial Sequence
  source: /note="Description of Artificial Sequence: Synthetic oligonucleotide"
uuaaauuaacagugcuaauga

SEQ ID NO: 3117 - RNA, 21 nt, Artificial Sequence
  source: /note="Description of Artificial Sequence: Synthetic oligonucleotide"
uaaauuaacagugcuaaugua

SEQ ID NO: 3118 - RNA, 21 nt, Artificial Sequence
  source: /note="Description of Artificial Sequence: Synthetic oligonucleotide"
aaauuaacagugcuaauguua

SEQ ID NO: 3119 - RNA, 21 nt, Artificial Sequence
  source: /note="Description of Artificial Sequence: Synthetic oligonucleotide"
aauuaacagugcuaauguuaa

SEQ ID NO: 3120 - RNA, 21 nt, Artificial Sequence
  source: /note="Description of Artificial Sequence: Synthetic oligonucleotide"
auuaacagugcuaauguuaua

SEQ ID NO: 3121 - RNA, 21 nt, Artificial Sequence
  source: /note="Description of Artificial Sequence: Synthetic oligonucleotide"
uuaacagugcuaauguuauua

SEQ ID NO: 3122 - RNA, 21 nt, Artificial Sequence
  source: /note="Description of Artificial Sequence: Synthetic oligonucleotide"
uaacagugcuaauguuauuga

SEQ ID NO: 3123 - RNA, 21 nt, Artificial Sequence
  source: /note="Description of Artificial Sequence: Synthetic oligonucleotide"
aacagugcuaauguuauugga

SEQ ID NO: 3124 - RNA, 21 nt, Artificial Sequence
  source: /note="Description of Artificial Sequence: Synthetic oligonucleotide"
acagugcuaauguuauuggua

SEQ ID NO: 3125 - RNA, 21 nt, Artificial Sequence
  source: /note="Description of Artificial Sequence: Synthetic oligonucleotide"
cagugcuaauguuauugguga

SEQ ID NO: 3126 - RNA, 21 nt, Artificial Sequence
  source: /note="Description of Artificial Sequence: Synthetic oligonucleotide"
gugcuaauguuauugguguca

SEQ ID NO: 3127 - RNA, 21 nt, Artificial Sequence
  source: /note="Description of Artificial Sequence: Synthetic oligonucleotide"
ugcuaauguuauuggugucua

SEQ ID NO: 3128 - RNA, 21 nt, Artificial Sequence
  source: /note="Description of Artificial Sequence: Synthetic oligonucleotide"
gcuaauguuauuggugucuua

SEQ ID NO: 3129 - RNA, 21 nt, Artificial Sequence
  source: /note="Description of Artificial Sequence: Synthetic oligonucleotide"
cuaauguuauuggugucuuca

SEQ ID NO: 3130 - RNA, 21 nt, Artificial Sequence
  source: /note="Description of Artificial Sequence: Synthetic oligonucleotide"
uaauguuauuggugucuucaa

SEQ ID NO: 3131 - RNA, 21 nt, Artificial Sequence
  source: /note="Description of Artificial Sequence: Synthetic oligonucleotide"
aauguuauuggugucuucaca

SEQ ID NO: 3132 - RNA, 21 nt, Artificial Sequence
  source: /note="Description of Artificial Sequence: Synthetic oligonucleotide"
auguuauuggugucuucacua

SEQ ID NO: 3133 - RNA, 21 nt, Artificial Sequence
  source: /note="Description of Artificial Sequence: Synthetic oligonucleotide"
uguuauuggugucuucacuga

SEQ ID NO: 3134 - RNA, 21 nt, Artificial Sequence
  source: /note="Description of Artificial Sequence: Synthetic oligonucleotide"
guuauuggugucuucacugga

SEQ ID NO: 3135 - RNA, 21 nt, Artificial Sequence
  source: /note="Description of Artificial Sequence: Synthetic oligonucleotide"
uuauuggugucuucacuggaa

SEQ ID NO: 3136 - RNA, 21 nt, Artificial Sequence
  source: /note="Description of Artificial Sequence: Synthetic oligonucleotide"
uggugucuucacuggauguaa

SEQ ID NO: 3137 - RNA, 21 nt, Artificial Sequence
  source: /note="Description of Artificial Sequence: Synthetic oligonucleotide"
ugucuucacuggauguauuua

SEQ ID NO: 3138 - RNA, 21 nt, Artificial Sequence
  source: /note="Description of Artificial Sequence: Synthetic oligonucleotide"
cacuggauguauuugacugca

SEQ ID NO: 3139 - RNA, 21 nt, Artificial Sequence
  source: /note="Description of Artificial Sequence: Synthetic oligonucleotide"
acuggauguauuugacugcua

SEQ ID NO: 3140 - RNA, 21 nt, Artificial Sequence
  source: /note="Description of Artificial Sequence: Synthetic oligonucleotide"
uggauguauuugacugcugua

SEQ ID NO: 3141 - RNA, 21 nt, Artificial Sequence
  source: /note="Description of Artificial Sequence: Synthetic oligonucleotide"
uauuugacugcuguggacuua

SEQ ID NO: 3142 - RNA, 21 nt, Artificial Sequence
  source: /note="Description of Artificial Sequence: Synthetic oligonucleotide"
uuugacugcuguggacuugaa

SEQ ID NO: 3143 - RNA, 21 nt, Artificial Sequence
  source: /note="Description of Artificial Sequence: Synthetic oligonucleotide"
gcuguggacuugaguugggaa

SEQ ID NO: 3144 - RNA, 21 nt, Artificial Sequence
  source: /note="Description of Artificial Sequence: Synthetic oligonucleotide"
ucccacucagauccugacaga

SEQ ID NO: 3145 - RNA, 21 nt, Artificial Sequence
  source: /note="Description of Artificial Sequence: Synthetic oligonucleotide"
cccacucagauccugacagga

SEQ ID NO: 3146 - RNA, 21 nt, Artificial Sequence
  source: /note="Description of Artificial Sequence: Synthetic oligonucleotide"
ggaggagaugagagacucuga

SEQ ID NO: 3147 - RNA, 21 nt, Artificial Sequence
  source: /note="Description of Artificial Sequence: Synthetic oligonucleotide"
gaggagaugagagacucugga

SEQ ID NO: 3148 - RNA, 21 nt, Artificial Sequence
  source: /note="Description of Artificial Sequence: Synthetic oligonucleotide"
ggagaugagagacucuggcaa

SEQ ID NO: 3149 - RNA, 21 nt, Artificial Sequence
  source: /note="Description of Artificial Sequence: Synthetic oligonucleotide"
gagacucuggcaugaucuuua

SEQ ID NO: 3150 - RNA, 21 nt, Artificial Sequence
  source: /note="Description of Artificial Sequence: Synthetic oligonucleotide"
agacucuggcaugaucuuuua

SEQ ID NO: 3151 - RNA, 21 nt, Artificial Sequence
  source: /note="Description of Artificial Sequence: Synthetic oligonucleotide"
uuuugggaacaccgacaaaca

SEQ ID NO: 3152 - RNA, 21 nt, Artificial Sequence
  source: /note="Description of Artificial Sequence: Synthetic oligonucleotide"
gagcuucaggacauugcugua

SEQ ID NO: 3153 - RNA, 21 nt, Artificial Sequence
  source: /note="Description of Artificial Sequence: Synthetic oligonucleotide"
gcuucaggacauugcugugca

SEQ ID NO: 3154 - RNA, 21 nt, Artificial Sequence
  source: /note="Description of Artificial Sequence: Synthetic oligonucleotide"
cuucaggacauugcugugcua

SEQ ID NO: 3155 - RNA, 21 nt, Artificial Sequence
  source: /note="Description of Artificial Sequence: Synthetic oligonucleotide"
uucaggacauugcugugcuua

SEQ ID NO: 3156 - RNA, 21 nt, Artificial Sequence
  source: /note="Description of Artificial Sequence: Synthetic oligonucleotide"
ucaggacauugcugugcuuua

SEQ ID NO: 3157 - RNA, 21 nt, Artificial Sequence
  source: /note="Description of Artificial Sequence: Synthetic oligonucleotide"
caggacauugcugugcuuuga

SEQ ID NO: 3158 - RNA, 21 nt, Artificial Sequence
  source: /note="Description of Artificial Sequence: Synthetic oligonucleotide"
cgcuuacucucaccugcuuca

SEQ ID NO: 3159 - RNA, 21 nt, Artificial Sequence
  source: /note="Description of Artificial Sequence: Synthetic oligonucleotide"
gcuuacucucaccugcuucua

SEQ ID NO: 3160 - RNA, 21 nt, Artificial Sequence
  source: /note="Description of Artificial Sequence: Synthetic oligonucleotide"
uuacucucaccugcuucugaa

SEQ ID NO: 3161 - RNA, 21 nt, Artificial Sequence
  source: /note="Description of Artificial Sequence: Synthetic oligonucleotide"
cucucaccugcuucugaguua

SEQ ID NO: 3162 - RNA, 21 nt, Artificial Sequence
  source: /note="Description of Artificial Sequence: Synthetic oligonucleotide"
ucucaccugcuucugaguuga

SEQ ID NO: 3163 - RNA, 21 nt, Artificial Sequence
  source: /note="Description of Artificial Sequence: Synthetic oligonucleotide"
cucaccugcuucugaguugca

SEQ ID NO: 3164 - RNA, 21 nt, Artificial Sequence
  source: /note="Description of Artificial Sequence: Synthetic oligonucleotide"
ucaccugcuucugaguugcca

SEQ ID NO: 3165 - RNA, 21 nt, Artificial Sequence
  source: /note="Description of Artificial Sequence: Synthetic oligonucleotide"
caccugcuucugaguugccca

SEQ ID NO: 3166 - RNA, 21 nt, Artificial Sequence
  source: /note="Description of Artificial Sequence: Synthetic oligonucleotide"
accugcuucugaguugcccaa

SEQ ID NO: 3167 - RNA, 21 nt, Artificial Sequence
  source: /note="Description of Artificial Sequence: Synthetic oligonucleotide"
ccugcuucugaguugcccaga

SEQ ID NO: 3168 - RNA, 21 nt, Artificial Sequence
  source: /note="Description of Artificial Sequence: Synthetic oligonucleotide"
cggcgaagagaagagacacaa

SEQ ID NO: 3169 - RNA, 21 nt, Artificial Sequence
  source: /note="Description of Artificial Sequence: Synthetic oligonucleotide"
ggcgaagagaagagacacaua

SEQ ID NO: 3170 - RNA, 21 nt, Artificial Sequence
  source: /note="Description of Artificial Sequence: Synthetic oligonucleotide"
gcgaagagaagagacacauua

SEQ ID NO: 3171 - RNA, 21 nt, Artificial Sequence
  source: /note="Description of Artificial Sequence: Synthetic oligonucleotide"
cgaagagaagagacacauuga

SEQ ID NO: 3172 - RNA, 21 nt, Artificial Sequence
  source: /note="Description of Artificial Sequence: Synthetic oligonucleotide"
gaagagaagagacacauugua

SEQ ID NO: 3173 - RNA, 21 nt, Artificial Sequence
  source: /note="Description of Artificial Sequence: Synthetic oligonucleotide"
aagagaagagacacauuguua

SEQ ID NO: 3174 - RNA, 21 nt, Artificial Sequence
  source: /note="Description of Artificial Sequence: Synthetic oligonucleotide"
agagaagagacacauuguuga

SEQ ID NO: 3175 - RNA, 21 nt, Artificial Sequence
  source: /note="Description of Artificial Sequence: Synthetic oligonucleotide"
gagaagagacacauuguugga

SEQ ID NO: 3176 - RNA, 21 nt, Artificial Sequence
  source: /note="Description of Artificial Sequence: Synthetic oligonucleotide"
agaagagacacauuguuggaa

SEQ ID NO: 3177 - RNA, 21 nt, Artificial Sequence
  source: /note="Description of Artificial Sequence: Synthetic oligonucleotide"
gaagagacacauuguuggaaa

SEQ ID NO: 3178 - RNA, 21 nt, Artificial Sequence
  source: /note="Description of Artificial Sequence: Synthetic oligonucleotide"
aagagacacauuguuggaaga

SEQ ID NO: 3179 - RNA, 21 nt, Artificial Sequence
  source: /note="Description of Artificial Sequence: Synthetic oligonucleotide"
agagacacauuguuggaagaa

SEQ ID NO: 3180 - RNA, 21 nt, Artificial Sequence
  source: /note="Description of Artificial Sequence: Synthetic oligonucleotide"
gagacacauuguuggaagaaa

SEQ ID NO: 3181 - RNA, 21 nt, Artificial Sequence
  source: /note="Description of Artificial Sequence: Synthetic oligonucleotide"
agacacauuguuggaagaaga

SEQ ID NO: 3182 - RNA, 21 nt, Artificial Sequence
  source: /note="Description of Artificial Sequence: Synthetic oligonucleotide"
gacacauuguuggaagaagca

SEQ ID NO: 3183 - RNA, 21 nt, Artificial Sequence
  source: /note="Description of Artificial Sequence: Synthetic oligonucleotide"
acacauuguuggaagaagcaa

SEQ ID NO: 3184 - RNA, 21 nt, Artificial Sequence
  source: /note="Description of Artificial Sequence: Synthetic oligonucleotide"
cacauuguuggaagaagcaga

SEQ ID NO: 3185 - RNA, 21 nt, Artificial Sequence
  source: /note="Description of Artificial Sequence: Synthetic oligonucleotide"
uauguccucacaccauugaaa

SEQ ID NO: 3186 - RNA, 21 nt, Artificial Sequence
  source: /note="Description of Artificial Sequence: Synthetic oligonucleotide"
uccucacaccauugaaaccaa

SEQ ID NO: 3187 - RNA, 21 nt, Artificial Sequence
  source: /note="Description of Artificial Sequence: Synthetic oligonucleotide"
ccucacaccauugaaaccaca

SEQ ID NO: 3188 - RNA, 21 nt, Artificial Sequence
  source: /note="Description of Artificial Sequence: Synthetic oligonucleotide"
cucacaccauugaaaccacua

SEQ ID NO: 3189 - RNA, 21 nt, Artificial Sequence
  source: /note="Description of Artificial Sequence: Synthetic oligonucleotide"
ucacaccauugaaaccacuaa

SEQ ID NO: 3190 - RNA, 21 nt, Artificial Sequence
  source: /note="Description of Artificial Sequence: Synthetic oligonucleotide"
cacaccauugaaaccacuaga

SEQ ID NO: 3191 - RNA, 21 nt, Artificial Sequence
  source: /note="Description of Artificial Sequence: Synthetic oligonucleotide"
ccauugaaaccacuaguucua

SEQ ID NO: 3192 - RNA, 21 nt, Artificial Sequence
  source: /note="Description of Artificial Sequence: Synthetic oligonucleotide"
cauugaaaccacuaguucuga

SEQ ID NO: 3193 - RNA, 21 nt, Artificial Sequence
  source: /note="Description of Artificial Sequence: Synthetic oligonucleotide"
auugaaaccacuaguucugua

SEQ ID NO: 3194 - RNA, 21 nt, Artificial Sequence
  source: /note="Description of Artificial Sequence: Synthetic oligonucleotide"
uugaaaccacuaguucuguca

SEQ ID NO: 3195 - RNA, 21 nt, Artificial Sequence
  source: /note="Description of Artificial Sequence: Synthetic oligonucleotide"
ugaaaccacuaguucugucca

SEQ ID NO: 3196 - RNA, 21 nt, Artificial Sequence
  source: /note="Description of Artificial Sequence: Synthetic oligonucleotide"
gaccugguuguguguguguga

SEQ ID NO: 3197 - RNA, 21 nt, Artificial Sequence
  source: /note="Description of Artificial Sequence: Synthetic oligonucleotide"
accugguugugugugugugaa

SEQ ID NO: 3198 - RNA, 21 nt, Artificial Sequence
  source: /note="Description of Artificial Sequence: Synthetic oligonucleotide"
ccugguugugugugugugaga

SEQ ID NO: 3199 - RNA, 21 nt, Artificial Sequence
  source: /note="Description of Artificial Sequence: Synthetic oligonucleotide"
cugguugugugugugugagua

SEQ ID NO: 3200 - RNA, 21 nt, Artificial Sequence
  source: /note="Description of Artificial Sequence: Synthetic oligonucleotide"
ugguugugugugugugaguga

SEQ ID NO: 3201 - RNA, 21 nt, Artificial Sequence
  source: /note="Description of Artificial Sequence: Synthetic oligonucleotide"
gguugugugugugugagugga

SEQ ID NO: 3202 - RNA, 21 nt, Artificial Sequence
  source: /note="Description of Artificial Sequence: Synthetic oligonucleotide"
gugugugugugagugguugaa

SEQ ID NO: 3203 - RNA, 21 nt, Artificial Sequence
  source: /note="Description of Artificial Sequence: Synthetic oligonucleotide"
ugugugugugagugguugaca

SEQ ID NO: 3204 - RNA, 21 nt, Artificial Sequence
  source: /note="Description of Artificial Sequence: Synthetic oligonucleotide"
ugugugugagugguugaccua

SEQ ID NO: 3205 - RNA, 21 nt, Artificial Sequence
  source: /note="Description of Artificial Sequence: Synthetic oligonucleotide"
ugugugagugguugaccuuca

SEQ ID NO: 3206 - RNA, 21 nt, Artificial Sequence
  source: /note="Description of Artificial Sequence: Synthetic oligonucleotide"
gugugagugguugaccuucca

SEQ ID NO: 3207 - RNA, 21 nt, Artificial Sequence
  source: /note="Description of Artificial Sequence: Synthetic oligonucleotide"
ugugagugguugaccuuccua

SEQ ID NO: 3208 - RNA, 21 nt, Artificial Sequence
  source: /note="Description of Artificial Sequence: Synthetic oligonucleotide"
ugagugguugaccuuccucca

SEQ ID NO: 3209 - RNA, 21 nt, Artificial Sequence
  source: /note="Description of Artificial Sequence: Synthetic oligonucleotide"
gugguugaccuuccuccauca

SEQ ID NO: 3210 - RNA, 21 nt, Artificial Sequence
  source: /note="Description of Artificial Sequence: Synthetic oligonucleotide"
uuguggaggcagagaaaagaa

SEQ ID NO: 3211 - RNA, 21 nt, Artificial Sequence
  source: /note="Description of Artificial Sequence: Synthetic oligonucleotide"
uguggaggcagagaaaagaga

SEQ ID NO: 3212 - RNA, 21 nt, Artificial Sequence
  source: /note="Description of Artificial Sequence: Synthetic oligonucleotide"
guggaggcagagaaaagagaa

SEQ ID NO: 3213 - RNA, 21 nt, Artificial Sequence
  source: /note="Description of Artificial Sequence: Synthetic oligonucleotide"
uggaggcagagaaaagagaaa

SEQ ID NO: 3214 - RNA, 21 nt, Artificial Sequence
  source: /note="Description of Artificial Sequence: Synthetic oligonucleotide"
ggaggcagagaaaagagaaaa

SEQ ID NO: 3215 - RNA, 21 nt, Artificial Sequence
  source: /note="Description of Artificial Sequence: Synthetic oligonucleotide"
gaggcagagaaaagagaaaga

SEQ ID NO: 3216 - RNA, 21 nt, Artificial Sequence
  source: /note="Description of Artificial Sequence: Synthetic oligonucleotide"
aggcagagaaaagagaaagua

SEQ ID NO: 3217 - RNA, 21 nt, Artificial Sequence
  source: /note="Description of Artificial Sequence: Synthetic oligonucleotide"
ggcagagaaaagagaaaguga

SEQ ID NO: 3218 - RNA, 21 nt, Artificial Sequence
  source: /note="Description of Artificial Sequence: Synthetic oligonucleotide"
gcagagaaaagagaaagugua

SEQ ID NO: 3219 - RNA, 21 nt, Artificial Sequence
  source: /note="Description of Artificial Sequence: Synthetic oligonucleotide"
cagagaaaagagaaaguguua

SEQ ID NO: 3220 - RNA, 21 nt, Artificial Sequence
  source: /note="Description of Artificial Sequence: Synthetic oligonucleotide"
agagaaaagagaaaguguuua

SEQ ID NO: 3221 - RNA, 21 nt, Artificial Sequence
  source: /note="Description of Artificial Sequence: Synthetic oligonucleotide"
gagaaaagagaaaguguuuua

SEQ ID NO: 3222 - RNA, 21 nt, Artificial Sequence
  source: /note="Description of Artificial Sequence: Synthetic oligonucleotide"
agaaaagagaaaguguuuuaa

SEQ ID NO: 3223 - RNA, 21 nt, Artificial Sequence
  source: /note="Description of Artificial Sequence: Synthetic oligonucleotide"
gaaaagagaaaguguuuuaua

SEQ ID NO: 3224 - RNA, 21 nt, Artificial Sequence
  source: /note="Description of Artificial Sequence: Synthetic oligonucleotide"
aaaagagaaaguguuuuauaa

SEQ ID NO: 3225 - RNA, 21 nt, Artificial Sequence
  source: /note="Description of Artificial Sequence: Synthetic oligonucleotide"
aaagagaaaguguuuuauaua

SEQ ID NO: 3226 - RNA, 21 nt, Artificial Sequence
  source: /note="Description of Artificial Sequence: Synthetic oligonucleotide"
aagagaaaguguuuuauauaa

SEQ ID NO: 3227 - RNA, 21 nt, Artificial Sequence
  source: /note="Description of Artificial Sequence: Synthetic oligonucleotide"
agagaaaguguuuuauauaca

SEQ ID NO: 3228 - RNA, 21 nt, Artificial Sequence
  source: /note="Description of Artificial Sequence: Synthetic oligonucleotide"
gagaaaguguuuuauauacga

SEQ ID NO: 3229 - RNA, 21 nt, Artificial Sequence
  source: /note="Description of Artificial Sequence: Synthetic oligonucleotide"
agaaaguguuuuauauacgga

SEQ ID NO: 3230 - RNA, 21 nt, Artificial Sequence
  source: /note="Description of Artificial Sequence: Synthetic oligonucleotide"
aaaguguuuuauauacgguaa

SEQ ID NO: 3231 - RNA, 21 nt, Artificial Sequence
  source: /note="Description of Artificial Sequence: Synthetic oligonucleotide"
aaguguuuuauauacgguaca

SEQ ID NO: 3232 - RNA, 21 nt, Artificial Sequence
  source: /note="Description of Artificial Sequence: Synthetic oligonucleotide"
aguguuuuauauacgguacua

SEQ ID NO: 3233 - RNA, 21 nt, Artificial Sequence
  source: /note="Description of Artificial Sequence: Synthetic oligonucleotide"
guguuuuauauacgguacuua

SEQ ID NO: 3234 - RNA, 21 nt, Artificial Sequence
  source: /note="Description of Artificial Sequence: Synthetic oligonucleotide"
uguuuuauauacgguacuuaa

SEQ ID NO: 3235 - RNA, 21 nt, Artificial Sequence
  source: /note="Description of Artificial Sequence: Synthetic oligonucleotide"
guuuuauauacgguacuuaua

SEQ ID NO: 3236 - RNA, 21 nt, Artificial Sequence
  source: /note="Description of Artificial Sequence: Synthetic oligonucleotide"
uuuuauauacgguacuuauua

SEQ ID NO: 3237 - RNA, 21 nt, Artificial Sequence
  source: /note="Description of Artificial Sequence: Synthetic oligonucleotide"
uuuauauacgguacuuauuua

SEQ ID NO: 3238 - RNA, 21 nt, Artificial Sequence
  source: /note="Description of Artificial Sequence: Synthetic oligonucleotide"
uuauauacgguacuuauuuaa

SEQ ID NO: 3239 - RNA, 21 nt, Artificial Sequence
  source: /note="Description of Artificial Sequence: Synthetic oligonucleotide"
uauauacgguacuuauuuaaa

SEQ ID NO: 3240 - RNA, 21 nt, Artificial Sequence
  source: /note="Description of Artificial Sequence: Synthetic oligonucleotide"
guacuuauuuaauaucccuua

SEQ ID NO: 3241 - RNA, 21 nt, Artificial Sequence
  source: /note="Description of Artificial Sequence: Synthetic oligonucleotide"
uacuuauuuaauaucccuuua

SEQ ID NO: 3242 - RNA, 21 nt, Artificial Sequence
  source: /note="Description of Artificial Sequence: Synthetic oligonucleotide"
uuaugagauguaucuuuugca

SEQ ID NO: 3243 - RNA, 21 nt, Artificial Sequence
  source: /note="Description of Artificial Sequence: Synthetic oligonucleotide"
uaugagauguaucuuuugcua

SEQ ID NO: 3244 - RNA, 21 nt, Artificial Sequence
  source: /note="Description of Artificial Sequence: Synthetic oligonucleotide"
augagauguaucuuuugcuca

SEQ ID NO: 3245 - RNA, 21 nt, Artificial Sequence
  source: /note="Description of Artificial Sequence: Synthetic oligonucleotide"
ugagauguaucuuuugcucua

SEQ ID NO: 3246 - RNA, 21 nt, Artificial Sequence
  source: /note="Description of Artificial Sequence: Synthetic oligonucleotide"
gagauguaucuuuugcucuca

SEQ ID NO: 3247 - RNA, 21 nt, Artificial Sequence
  source: /note="Description of Artificial Sequence: Synthetic oligonucleotide"
agauguaucuuuugcucucua

SEQ ID NO: 3248 - RNA, 21 nt, Artificial Sequence
  source: /note="Description of Artificial Sequence: Synthetic oligonucleotide"
gauguaucuuuugcucucuca

SEQ ID NO: 3249 - RNA, 21 nt, Artificial Sequence
  source: /note="Description of Artificial Sequence: Synthetic oligonucleotide"
auguaucuuuugcucucucua

SEQ ID NO: 3250 - RNA, 21 nt, Artificial Sequence
  source: /note="Description of Artificial Sequence: Synthetic oligonucleotide"
gcucucucuugcucucuuaua

SEQ ID NO: 3251 - RNA, 21 nt, Artificial Sequence
  source: /note="Description of Artificial Sequence: Synthetic oligonucleotide"
cucucucuugcucucuuauua

SEQ ID NO: 3252 - RNA, 21 nt, Artificial Sequence
  source: /note="Description of Artificial Sequence: Synthetic oligonucleotide"
ucucucuugcucucuuauuua

SEQ ID NO: 3253 - RNA, 21 nt, Artificial Sequence
  source: /note="Description of Artificial Sequence: Synthetic oligonucleotide"
cucucuugcucucuuauuuga

SEQ ID NO: 3254 - RNA, 21 nt, Artificial Sequence
  source: /note="Description of Artificial Sequence: Synthetic oligonucleotide"
ucucuugcucucuuauuugua

SEQ ID NO: 3255 - RNA, 21 nt, Artificial Sequence
  source: /note="Description of Artificial Sequence: Synthetic oligonucleotide"
cucuugcucucuuauuuguaa

SEQ ID NO: 3256 - RNA, 21 nt, Artificial Sequence
  source: /note="Description of Artificial Sequence: Synthetic oligonucleotide"
ucuugcucucuuauuuguaca

SEQ ID NO: 3257 - RNA, 21 nt, Artificial Sequence
  source: /note="Description of Artificial Sequence: Synthetic oligonucleotide"
cuugcucucuuauuuguacca

SEQ ID NO: 3258 - RNA, 21 nt, Artificial Sequence
  source: /note="Description of Artificial Sequence: Synthetic oligonucleotide"
uugcucucuuauuuguaccga

SEQ ID NO: 3259 - RNA, 21 nt, Artificial Sequence
  source: /note="Description of Artificial Sequence: Synthetic oligonucleotide"
ugcucucuuauuuguaccgga

SEQ ID NO: 3260 - RNA, 21 nt, Artificial Sequence
  source: /note="Description of Artificial Sequence: Synthetic oligonucleotide"
cucucuuauuuguaccgguua

SEQ ID NO: 3261 - RNA, 21 nt, Artificial Sequence
  source: /note="Description of Artificial Sequence: Synthetic oligonucleotide"
ucucuuauuuguaccgguuua

SEQ ID NO: 3262 - RNA, 21 nt, Artificial Sequence
  source: /note="Description of Artificial Sequence: Synthetic oligonucleotide"
cucuuauuuguaccgguuuua

SEQ ID NO: 3263 - RNA, 21 nt, Artificial Sequence
  source: /note="Description of Artificial Sequence: Synthetic oligonucleotide"
ucuuauuuguaccgguuuuua

SEQ ID NO: 3264 - RNA, 21 nt, Artificial Sequence
  source: /note="Description of Artificial Sequence: Synthetic oligonucleotide"
cuuauuuguaccgguuuuuga

SEQ ID NO: 3265 - RNA, 21 nt, Artificial Sequence
  source: /note="Description of Artificial Sequence: Synthetic oligonucleotide"
uuauuuguaccgguuuuugua

SEQ ID NO: 3266 - RNA, 21 nt, Artificial Sequence
  source: /note="Description of Artificial Sequence: Synthetic oligonucleotide"
uauuuguaccgguuuuuguaa

SEQ ID NO: 3267 - RNA, 21 nt, Artificial Sequence
  source: /note="Description of Artificial Sequence: Synthetic oligonucleotide"
auuuguaccgguuuuuguaua

SEQ ID NO: 3268 - RNA, 21 nt, Artificial Sequence
  source: /note="Description of Artificial Sequence: Synthetic oligonucleotide"
uuuguaccgguuuuuguauaa

SEQ ID NO: 3269 - RNA, 21 nt, Artificial Sequence
  source: /note="Description of Artificial Sequence: Synthetic oligonucleotide"
uuguaccgguuuuuguauaua

SEQ ID NO: 3270 - RNA, 21 nt, Artificial Sequence
  source: /note="Description of Artificial Sequence: Synthetic oligonucleotide"
uguaccgguuuuuguauauaa

SEQ ID NO: 3271 - RNA, 21 nt, Artificial Sequence
  source: /note="Description of Artificial Sequence: Synthetic oligonucleotide"
guaccgguuuuuguauauaaa

SEQ ID NO: 3272 - RNA, 21 nt, Artificial Sequence
  source: /note="Description of Artificial Sequence: Synthetic oligonucleotide"
uaccgguuuuuguauauaaaa

SEQ ID NO: 3273 - RNA, 21 nt, Artificial Sequence
  source: /note="Description of Artificial Sequence: Synthetic oligonucleotide"
accgguuuuuguauauaaaaa

SEQ ID NO: 3274 - RNA, 21 nt, Artificial Sequence
  source: /note="Description of Artificial Sequence: Synthetic oligonucleotide"
auucauguuuccaaucucuca

SEQ ID NO: 3275 - RNA, 21 nt, Artificial Sequence
  source: /note="Description of Artificial Sequence: Synthetic oligonucleotide"
uucauguuuccaaucucucua

SEQ ID NO: 3276 - RNA, 21 nt, Artificial Sequence
  source: /note="Description of Artificial Sequence: Synthetic oligonucleotide"
ucauguuuccaaucucucuca

SEQ ID NO: 3277 - RNA, 21 nt, Artificial Sequence
  source: /note="Description of Artificial Sequence: Synthetic oligonucleotide"
cauguuuccaaucucucucua

SEQ ID NO: 3278 - RNA, 21 nt, Artificial Sequence
  source: /note="Description of Artificial Sequence: Synthetic oligonucleotide"
auguuuccaaucucucucuca

SEQ ID NO: 3279 - RNA, 21 nt, Artificial Sequence
  source: /note="Description of Artificial Sequence: Synthetic oligonucleotide"
uguuuccaaucucucucucca

SEQ ID NO: 3280 - RNA, 21 nt, Artificial Sequence
  source: /note="Description of Artificial Sequence: Synthetic oligonucleotide"
uuuccaaucucucucucccua

SEQ ID NO: 3281 - RNA, 21 nt, Artificial Sequence
  source: /note="Description of Artificial Sequence: Synthetic oligonucleotide"
uccaaucucucucucccugaa

SEQ ID NO: 3282 - RNA, 21 nt, Artificial Sequence
  source: /note="Description of Artificial Sequence: Synthetic oligonucleotide"
cggugacagucacuagcuuaa

SEQ ID NO: 3283 - RNA, 21 nt, Artificial Sequence
  source: /note="Description of Artificial Sequence: Synthetic oligonucleotide"
ggugacagucacuagcuuaua

SEQ ID NO: 3284 - RNA, 21 nt, Artificial Sequence
  source: /note="Description of Artificial Sequence: Synthetic oligonucleotide"
agucacuagcuuaucuugaaa

SEQ ID NO: 3285 - RNA, 21 nt, Artificial Sequence
  source: /note="Description of Artificial Sequence: Synthetic oligonucleotide"
gucacuagcuuaucuugaaca

SEQ ID NO: 3286 - RNA, 21 nt, Artificial Sequence
  source: /note="Description of Artificial Sequence: Synthetic oligonucleotide"
ucacuagcuuaucuugaacaa

SEQ ID NO: 3287 - RNA, 21 nt, Artificial Sequence
  source: /note="Description of Artificial Sequence: Synthetic oligonucleotide"
acuagcuuaucuugaacagaa

SEQ ID NO: 3288 - RNA, 21 nt, Artificial Sequence
  source: /note="Description of Artificial Sequence: Synthetic oligonucleotide"
cuagcuuaucuugaacagaua

SEQ ID NO: 3289 - RNA, 21 nt, Artificial Sequence
  source: /note="Description of Artificial Sequence: Synthetic oligonucleotide"
uagcuuaucuugaacagauaa

SEQ ID NO: 3290 - RNA, 21 nt, Artificial Sequence
  source: /note="Description of Artificial Sequence: Synthetic oligonucleotide"
agcuuaucuugaacagauaua

SEQ ID NO: 3291 - RNA, 21 nt, Artificial Sequence
  source: /note="Description of Artificial Sequence: Synthetic oligonucleotide"
gcuuaucuugaacagauauua

SEQ ID NO: 3292 - RNA, 21 nt, Artificial Sequence
  source: /note="Description of Artificial Sequence: Synthetic oligonucleotide"
cagcacacauuccuuugaaaa

SEQ ID NO: 3293 - RNA, 21 nt, Artificial Sequence
  source: /note="Description of Artificial Sequence: Synthetic oligonucleotide"
agcacacauuccuuugaaaua

SEQ ID NO: 3294 - RNA, 21 nt, Artificial Sequence
  source: /note="Description of Artificial Sequence: Synthetic oligonucleotide"
gcacacauuccuuugaaauaa

SEQ ID NO: 3295 - RNA, 21 nt, Artificial Sequence
  source: /note="Description of Artificial Sequence: Synthetic oligonucleotide"
cacacauuccuuugaaauaaa

SEQ ID NO: 3296 - RNA, 21 nt, Artificial Sequence
  source: /note="Description of Artificial Sequence: Synthetic oligonucleotide"
cacauuccuuugaaauaagga

SEQ ID NO: 3297 - RNA, 21 nt, Artificial Sequence
  source: /note="Description of Artificial Sequence: Synthetic oligonucleotide"
uccuuugaaauaagguuucaa

SEQ ID NO: 3298 - RNA, 21 nt, Artificial Sequence
  source: /note="Description of Artificial Sequence: Synthetic oligonucleotide"
cuuugaaauaagguuucaaua

SEQ ID NO: 3299 - RNA, 21 nt, Artificial Sequence
  source: /note="Description of Artificial Sequence: Synthetic oligonucleotide"
uuugaaauaagguuucaauaa

SEQ ID NO: 3300 - RNA, 21 nt, Artificial Sequence
  source: /note="Description of Artificial Sequence: Synthetic oligonucleotide"
agguuucaauauacaucuaca

SEQ ID NO: 3301 - RNA, 21 nt, Artificial Sequence
  source: /note="Description of Artificial Sequence: Synthetic oligonucleotide"
gguuucaauauacaucuacaa

SEQ ID NO: 3302 - RNA, 21 nt, Artificial Sequence
  source: /note="Description of Artificial Sequence: Synthetic oligonucleotide"
guuucaauauacaucuacaua

SEQ ID NO: 3303 - RNA, 21 nt, Artificial Sequence
  source: /note="Description of Artificial Sequence: Synthetic oligonucleotide"
uuucaauauacaucuacauaa

SEQ ID NO: 3304 - RNA, 21 nt, Artificial Sequence
  source: /note="Description of Artificial Sequence: Synthetic oligonucleotide"
uucaauauacaucuacauaca

SEQ ID NO: 3305 - RNA, 21 nt, Artificial Sequence
  source: /note="Description of Artificial Sequence: Synthetic oligonucleotide"
uauuuggcaacuuguauuuga

SEQ ID NO: 3306 - RNA, 21 nt, Artificial Sequence
  source: /note="Description of Artificial Sequence: Synthetic oligonucleotide"
uuuggcaacuuguauuuguga

SEQ ID NO: 3307 - RNA, 21 nt, Artificial Sequence
  source: /note="Description of Artificial Sequence: Synthetic oligonucleotide"
uggcaacuuguauuuguguga

SEQ ID NO: 3308 - RNA, 21 nt, Artificial Sequence
  source: /note="Description of Artificial Sequence: Synthetic oligonucleotide"
ggcaacuuguauuugugugua

SEQ ID NO: 3309 - RNA, 21 nt, Artificial Sequence
  source: /note="Description of Artificial Sequence: Synthetic oligonucleotide"
gcaacuuguauuuguguguaa

SEQ ID NO: 3310 - RNA, 21 nt, Artificial Sequence
  source: /note="Description of Artificial Sequence: Synthetic oligonucleotide"
caacuuguauuuguguguaua

SEQ ID NO: 3311 - RNA, 21 nt, Artificial Sequence
  source: /note="Description of Artificial Sequence: Synthetic oligonucleotide"
aacuuguauuuguguguauaa

SEQ ID NO: 3312 - RNA, 21 nt, Artificial Sequence
  source: /note="Description of Artificial Sequence: Synthetic oligonucleotide"
acuuguauuuguguguauaua

SEQ ID NO: 3313 - RNA, 21 nt, Artificial Sequence
  source: /note="Description of Artificial Sequence: Synthetic oligonucleotide"
uucugauaaaauagacauuga

SEQ ID NO: 3314 - RNA, 21 nt, Artificial Sequence
  source: /note="Description of Artificial Sequence: Synthetic oligonucleotide"
ugauaaaauagacauugcuaa

SEQ ID NO: 3315 - RNA, 21 nt, Artificial Sequence
  source: /note="Description of Artificial Sequence: Synthetic oligonucleotide"
gauaaaauagacauugcuaua

SEQ ID NO: 3316 - RNA, 21 nt, Artificial Sequence
  source: /note="Description of Artificial Sequence: Synthetic oligonucleotide"
uaaaauagacauugcuauuca

SEQ ID NO: 3317 - RNA, 21 nt, Artificial Sequence
  source: /note="Description of Artificial Sequence: Synthetic oligonucleotide"
uagacauugcuauucuguuua

SEQ ID NO: 3318 - RNA, 21 nt, Artificial Sequence
  source: /note="Description of Artificial Sequence: Synthetic oligonucleotide"
agacauugcuauucuguuuua

SEQ ID NO: 3319 - RNA, 21 nt, Artificial Sequence
  source: /note="Description of Artificial Sequence: Synthetic oligonucleotide"
ucuacauacuaaaucucucua

SEQ ID NO: 3320 - RNA, 21 nt, Artificial Sequence
  source: /note="Description of Artificial Sequence: Synthetic oligonucleotide"
cuacauacuaaaucucucuca

SEQ ID NO: 3321 - RNA, 21 nt, Artificial Sequence
  source: /note="Description of Artificial Sequence: Synthetic oligonucleotide"
uacauacuaaaucucucucca

SEQ ID NO: 3322 - RNA, 21 nt, Artificial Sequence
  source: /note="Description of Artificial Sequence: Synthetic oligonucleotide"
acauacuaaaucucucuccua

SEQ ID NO: 3323 - RNA, 21 nt, Artificial Sequence
  source: /note="Description of Artificial Sequence: Synthetic oligonucleotide"
cauacuaaaucucucuccuua

SEQ ID NO: 3324 - RNA, 21 nt, Artificial Sequence
  source: /note="Description of Artificial Sequence: Synthetic oligonucleotide"
auacuaaaucucucuccuuua

SEQ ID NO: 3325 - RNA, 21 nt, Artificial Sequence
  source: /note="Description of Artificial Sequence: Synthetic oligonucleotide"
uacuaaaucucucuccuuuua

SEQ ID NO: 3326 - RNA, 21 nt, Artificial Sequence
  source: /note="Description of Artificial Sequence: Synthetic oligonucleotide"
cauuuauuuauuggugcuaca

SEQ ID NO: 3327 - RNA, 21 nt, Artificial Sequence
  source: /note="Description of Artificial Sequence: Synthetic oligonucleotide"
auuuauuuauuggugcuacua

SEQ ID NO: 3328 - RNA, 21 nt, Artificial Sequence
  source: /note="Description of Artificial Sequence: Synthetic oligonucleotide"
uuuauuuauuggugcuacuga

SEQ ID NO: 3329 - RNA, 21 nt, Artificial Sequence
  source: /note="Description of Artificial Sequence: Synthetic oligonucleotide"
uuauuuauuggugcuacugua

SEQ ID NO: 3330 - RNA, 21 nt, Artificial Sequence
  source: /note="Description of Artificial Sequence: Synthetic oligonucleotide"
uauuuauuggugcuacuguua

SEQ ID NO: 3331 - RNA, 21 nt, Artificial Sequence
  source: /note="Description of Artificial Sequence: Synthetic oligonucleotide"
auuuauuggugcuacuguuua

SEQ ID NO: 3332 - RNA, 21 nt, Artificial Sequence
  source: /note="Description of Artificial Sequence: Synthetic oligonucleotide"
uuauuggugcuacuguuuaua

SEQ ID NO: 3333 - RNA, 21 nt, Artificial Sequence
  source: /note="Description of Artificial Sequence: Synthetic oligonucleotide"
auuggugcuacuguuuaucca

SEQ ID NO: 3334 - RNA, 21 nt, Artificial Sequence
  source: /note="Description of Artificial Sequence: Synthetic oligonucleotide"
gaaaagauauuaacaucacga

SEQ ID NO: 3335 - RNA, 21 nt, Artificial Sequence
  source: /note="Description of Artificial Sequence: Synthetic oligonucleotide"
aacaucacgucuuugucucua

SEQ ID NO: 3336 - RNA, 21 nt, Artificial Sequence
  source: /note="Description of Artificial Sequence: Synthetic oligonucleotide"
acaucacgucuuugucucuaa

SEQ ID NO: 3337 - RNA, 21 nt, Artificial Sequence
  source: /note="Description of Artificial Sequence: Synthetic oligonucleotide"
gucuuugucucuagugcagua

SEQ ID NO: 3338 - RNA, 21 nt, Artificial Sequence
  source: /note="Description of Artificial Sequence: Synthetic oligonucleotide"
ucuuugucucuagugcaguua

SEQ ID NO: 3339 - RNA, 21 nt, Artificial Sequence
  source: /note="Description of Artificial Sequence: Synthetic oligonucleotide"
cuuugucucuagugcaguuua

SEQ ID NO: 3340 - RNA, 21 nt, Artificial Sequence
  source: /note="Description of Artificial Sequence: Synthetic oligonucleotide"
gagauauuccguaguacauaa

SEQ ID NO: 3341 - RNA, 21 nt, Artificial Sequence
  source: /note="Description of Artificial Sequence: Synthetic oligonucleotide"
agauauuccguaguacauaua

SEQ ID NO: 3342 - RNA, 21 nt, Artificial Sequence
  source: /note="Description of Artificial Sequence: Synthetic oligonucleotide"
gauauuccguaguacauauua

SEQ ID NO: 3343 - RNA, 21 nt, Artificial Sequence
  source: /note="Description of Artificial Sequence: Synthetic oligonucleotide"
cgacaaagaaauacagauaua

SEQ ID NO: 3344 - RNA, 21 nt, Artificial Sequence
  source: /note="Description of Artificial Sequence: Synthetic oligonucleotide"
gacaaagaaauacagauauaa

SEQ ID NO: 3345 - RNA, 21 nt, Artificial Sequence
  source: /note="Description of Artificial Sequence: Synthetic oligonucleotide"
acaaagaaauacagauauaua

SEQ ID NO: 3346 - RNA, 21 nt, Artificial Sequence
  source: /note="Description of Artificial Sequence: Synthetic oligonucleotide"
caaagaaauacagauauauca

SEQ ID NO: 3347 - RNA, 23 nt, Artificial Sequence
  source: /note="Description of Artificial Sequence: Synthetic oligonucleotide"
uaauaucaaauuccagcaccgag

SEQ ID NO: 3348 - RNA, 23 nt, Artificial Sequence
  source: /note="Description of Artificial Sequence: Synthetic oligonucleotide"
ugaauaucaaauuccagcaccga

SEQ ID NO: 3349 - RNA, 23 nt, Artificial Sequence
  source: /note="Description of Artificial Sequence: Synthetic oligonucleotide"
uaugaauaucaaauuccagcacc

SEQ ID NO: 3350 - RNA, 23 nt, Artificial Sequence
  source: /note="Description of Artificial Sequence: Synthetic oligonucleotide"
uaaugaauaucaaauuccagcac

SEQ ID NO: 3351 - RNA, 23 nt, Artificial Sequence
  source: /note="Description of Artificial Sequence: Synthetic oligonucleotide"
uucaaugaauaucaaauuccagc

SEQ ID NO: 3352 - RNA, 23 nt, Artificial Sequence
  source: /note="Description of Artificial Sequence: Synthetic oligonucleotide"
uaucaaugaauaucaaauuccag

SEQ ID NO: 3353 - RNA, 23 nt, Artificial Sequence
  source: /note="Description of Artificial Sequence: Synthetic oligonucleotide"
ugaucaaugaauaucaaauucca

SEQ ID NO: 3354 - RNA, 23 nt, Artificial Sequence
  source: /note="Description of Artificial Sequence: Synthetic oligonucleotide"
uggaucaaugaauaucaaauucc

SEQ ID NO: 3355 - RNA, 23 nt, Artificial Sequence
  source: /note="Description of Artificial Sequence: Synthetic oligonucleotide"
ucggaucaaugaauaucaaauuc

SEQ ID NO: 3356 - RNA, 23 nt, Artificial Sequence
  source: /note="Description of Artificial Sequence: Synthetic oligonucleotide"
uccggaucaaugaauaucaaauu

SEQ ID NO: 3357 - RNA, 23 nt, Artificial Sequence
  source: /note="Description of Artificial Sequence: Synthetic oligonucleotide"
ugaauggcaagcaaaaauaaauu

SEQ ID NO: 3358 - RNA, 23 nt, Artificial Sequence
  source: /note="Description of Artificial Sequence: Synthetic oligonucleotide"
uggaauggcaagcaaaaauaaau

SEQ ID NO: 3359 - RNA, 23 nt, Artificial Sequence
  source: /note="Description of Artificial Sequence: Synthetic oligonucleotide"
uccaaaauccacagugauuuggg

SEQ ID NO: 3360 - RNA, 23 nt, Artificial Sequence
  source: /note="Description of Artificial Sequence: Synthetic oligonucleotide"
uuccaaaauccacagugauuugg

SEQ ID NO: 3361 - RNA, 23 nt, Artificial Sequence
  source: /note="Description of Artificial Sequence: Synthetic oligonucleotide"
uuuccaaaauccacagugauuug

SEQ ID NO: 3362 - RNA, 23 nt, Artificial Sequence
  source: /note="Description of Artificial Sequence: Synthetic oligonucleotide"
uuuuccaaaauccacagugauuu

SEQ ID NO: 3363 - RNA, 23 nt, Artificial Sequence
  source: /note="Description of Artificial Sequence: Synthetic oligonucleotide"
uguuuccaaaauccacagugauu

SEQ ID NO: 3364 - RNA, 23 nt, Artificial Sequence
  source: /note="Description of Artificial Sequence: Synthetic oligonucleotide"
ugguuuccaaaauccacagugau

SEQ ID NO: 3365 - RNA, 23 nt, Artificial Sequence
  source: /note="Description of Artificial Sequence: Synthetic oligonucleotide"
uugguuuccaaaauccacaguga

SEQ ID NO: 3366 - RNA, 23 nt, Artificial Sequence
  source: /note="Description of Artificial Sequence: Synthetic oligonucleotide"
ucugguuuccaaaauccacagug

SEQ ID NO: 3367 - RNA, 23 nt, Artificial Sequence
  source: /note="Description of Artificial Sequence: Synthetic oligonucleotide"
ugcugguuuccaaaauccacagu

SEQ ID NO: 3368 - RNA, 23 nt, Artificial Sequence
  source: /note="Description of Artificial Sequence: Synthetic oligonucleotide"
uugcugguuuccaaaauccacag

SEQ ID NO: 3369 - RNA, 23 nt, Artificial Sequence
  source: /note="Description of Artificial Sequence: Synthetic oligonucleotide"
uuucugcugguuuccaaaaucca

SEQ ID NO: 3370 - RNA, 23 nt, Artificial Sequence
  source: /note="Description of Artificial Sequence: Synthetic oligonucleotide"
uuuucugcugguuuccaaaaucc

SEQ ID NO: 3371 - RNA, 23 nt, Artificial Sequence
  source: /note="Description of Artificial Sequence: Synthetic oligonucleotide"
ucuuucugcugguuuccaaaauc

SEQ ID NO: 3372 - RNA, 23 nt, Artificial Sequence
  source: /note="Description of Artificial Sequence: Synthetic oligonucleotide"
uucuuucugcugguuuccaaaau

SEQ ID NO: 3373 - RNA, 23 nt, Artificial Sequence
  source: /note="Description of Artificial Sequence: Synthetic oligonucleotide"
uuccucuuucugcugguuuccaa

SEQ ID NO: 3374 - RNA, 23 nt, Artificial Sequence
  source: /note="Description of Artificial Sequence: Synthetic oligonucleotide"
uuuuccucuuucugcugguuucc

SEQ ID NO: 3375 - RNA, 23 nt, Artificial Sequence
  source: /note="Description of Artificial Sequence: Synthetic oligonucleotide"
ucuuuccucuuucugcugguuuc

SEQ ID NO: 3376 - RNA, 23 nt, Artificial Sequence
  source: /note="Description of Artificial Sequence: Synthetic oligonucleotide"
uucuuuccucuuucugcugguuu

SEQ ID NO: 3377 - RNA, 23 nt, Artificial Sequence
  source: /note="Description of Artificial Sequence: Synthetic oligonucleotide"
ucucuuuccucuuucugcugguu

SEQ ID NO: 3378 - RNA, 23 nt, Artificial Sequence
  source: /note="Description of Artificial Sequence: Synthetic oligonucleotide"
uccucuuuccucuuucugcuggu

SEQ ID NO: 3379 - RNA, 23 nt, Artificial Sequence
  source: /note="Description of Artificial Sequence: Synthetic oligonucleotide"
uaccucuuuccucuuucugcugg

SEQ ID NO: 3380 - RNA, 23 nt, Artificial Sequence
  source: /note="Description of Artificial Sequence: Synthetic oligonucleotide"
uuaccucuuuccucuuucugcug

SEQ ID NO: 3381 - RNA, 23 nt, Artificial Sequence
  source: /note="Description of Artificial Sequence: Synthetic oligonucleotide"
ucuaccucuuuccucuuucugcu

SEQ ID NO: 3382 - RNA, 23 nt, Artificial Sequence
  source: /note="Description of Artificial Sequence: Synthetic oligonucleotide"
uuugcuaccucuuuccucuuucu

SEQ ID NO: 3383 - RNA, 23 nt, Artificial Sequence
  source: /note="Description of Artificial Sequence: Synthetic oligonucleotide"
ucuugcuaccucuuuccucuuuc

SEQ ID NO: 3384 - RNA, 23 nt, Artificial Sequence
  source: /note="Description of Artificial Sequence: Synthetic oligonucleotide"
uucuugcuaccucuuuccucuuu

SEQ ID NO: 3385 - RNA, 23 nt, Artificial Sequence
  source: /note="Description of Artificial Sequence: Synthetic oligonucleotide"
ucucuugcuaccucuuuccucuu

SEQ ID NO: 3386 - RNA, 23 nt, Artificial Sequence
  source: /note="Description of Artificial Sequence: Synthetic oligonucleotide"
uagcucuugcuaccucuuuccuc

SEQ ID NO: 3387 - RNA, 23 nt, Artificial Sequence
  source: /note="Description of Artificial Sequence: Synthetic oligonucleotide"
ucucuggagcucuugcuaccucu

SEQ ID NO: 3388 - RNA, 23 nt, Artificial Sequence
  source: /note="Description of Artificial Sequence: Synthetic oligonucleotide"
uuuccucgacuucucucuggagc

SEQ ID NO: 3389 - RNA, 23 nt, Artificial Sequence
  source: /note="Description of Artificial Sequence: Synthetic oligonucleotide"
ucuuccucgacuucucucuggag

SEQ ID NO: 3390 - RNA, 23 nt, Artificial Sequence
  source: /note="Description of Artificial Sequence: Synthetic oligonucleotide"
uucuuccucgacuucucucugga

SEQ ID NO: 3391 - RNA, 23 nt, Artificial Sequence
  source: /note="Description of Artificial Sequence: Synthetic oligonucleotide"
ucucucuuccucgacuucucucu

SEQ ID NO: 3392 - RNA, 23 nt, Artificial Sequence
  source: /note="Description of Artificial Sequence: Synthetic oligonucleotide"
uucucucuuccucgacuucucuc

SEQ ID NO: 3393 - RNA, 23 nt, Artificial Sequence
  source: /note="Description of Artificial Sequence: Synthetic oligonucleotide"
uucucucucuuccucgacuucuc

SEQ ID NO: 3394 - RNA, 23 nt, Artificial Sequence
  source: /note="Description of Artificial Sequence: Synthetic oligonucleotide"
uccaaaagcaggucacucacuuu

SEQ ID NO: 3395 - RNA, 23 nt, Artificial Sequence
  source: /note="Description of Artificial Sequence: Synthetic oligonucleotide"
uaaaaguuucagugcgacgccgc

SEQ ID NO: 3396 - RNA, 23 nt, Artificial Sequence
  source: /note="Description of Artificial Sequence: Synthetic oligonucleotide"
uacgaaaaguuucagugcgacgc

SEQ ID NO: 3397 - RNA, 23 nt, Artificial Sequence
  source: /note="Description of Artificial Sequence: Synthetic oligonucleotide"
ugacgaaaaguuucagugcgacg

SEQ ID NO: 3398 - RNA, 23 nt, Artificial Sequence
  source: /note="Description of Artificial Sequence: Synthetic oligonucleotide"
uuuggacgaaaaguuucagugcg

SEQ ID NO: 3399 - RNA, 23 nt, Artificial Sequence
  source: /note="Description of Artificial Sequence: Synthetic oligonucleotide"
uguuggacgaaaaguuucagugc

SEQ ID NO: 3400 - RNA, 23 nt, Artificial Sequence
  source: /note="Description of Artificial Sequence: Synthetic oligonucleotide"
uaaguuggacgaaaaguuucagu

SEQ ID NO: 3401 - RNA, 23 nt, Artificial Sequence
  source: /note="Description of Artificial Sequence: Synthetic oligonucleotide"
ucagaaguuggacgaaaaguuuc

SEQ ID NO: 3402 - RNA, 23 nt, Artificial Sequence
  source: /note="Description of Artificial Sequence: Synthetic oligonucleotide"
uccgaagcgagaacagcccagaa

SEQ ID NO: 3403 - RNA, 23 nt, Artificial Sequence
  source: /note="Description of Artificial Sequence: Synthetic oligonucleotide"
uuccgaagcgagaacagcccaga

SEQ ID NO: 3404 - RNA, 23 nt, Artificial Sequence
  source: /note="Description of Artificial Sequence: Synthetic oligonucleotide"
ucuccgaagcgagaacagcccag

SEQ ID NO: 3405 - RNA, 23 nt, Artificial Sequence
  source: /note="Description of Artificial Sequence: Synthetic oligonucleotide"
uuccuccgaagcgagaacagccc

SEQ ID NO: 3406 - RNA, 23 nt, Artificial Sequence
  source: /note="Description of Artificial Sequence: Synthetic oligonucleotide"
ugagcuagcacuucucgcggcuc

SEQ ID NO: 3407 - RNA, 23 nt, Artificial Sequence
  source: /note="Description of Artificial Sequence: Synthetic oligonucleotide"
ucgagcuagcacuucucgcggcu

SEQ ID NO: 3408 - RNA, 23 nt, Artificial Sequence
  source: /note="Description of Artificial Sequence: Synthetic oligonucleotide"
uaaguucaugguuucggaggccc

SEQ ID NO: 3409 - RNA, 23 nt, Artificial Sequence
  source: /note="Description of Artificial Sequence: Synthetic oligonucleotide"
uaugauucugcccuccuccuucu

SEQ ID NO: 3410 - RNA, 23 nt, Artificial Sequence
  source: /note="Description of Artificial Sequence: Synthetic oligonucleotide"
ucacuucgugaugauucugcccu

SEQ ID NO: 3411 - RNA, 23 nt, Artificial Sequence
  source: /note="Description of Artificial Sequence: Synthetic oligonucleotide"
uuucaccacuucgugaugauucu

SEQ ID NO: 3412 - RNA, 23 nt, Artificial Sequence
  source: /note="Description of Artificial Sequence: Synthetic oligonucleotide"
ucuucaccacuucgugaugauuc

SEQ ID NO: 3413 - RNA, 23 nt, Artificial Sequence
  source: /note="Description of Artificial Sequence: Synthetic oligonucleotide"
uacuucaccacuucgugaugauu

SEQ ID NO: 3414 - RNA, 23 nt, Artificial Sequence
  source: /note="Description of Artificial Sequence: Synthetic oligonucleotide"
uaacuucaccacuucgugaugau

SEQ ID NO: 3415 - RNA, 23 nt, Artificial Sequence
  source: /note="Description of Artificial Sequence: Synthetic oligonucleotide"
uugaacuucaccacuucgugaug

SEQ ID NO: 3416 - RNA, 23 nt, Artificial Sequence
  source: /note="Description of Artificial Sequence: Synthetic oligonucleotide"
uauccaugaacuucaccacuucg

SEQ ID NO: 3417 - RNA, 23 nt, Artificial Sequence
  source: /note="Description of Artificial Sequence: Synthetic oligonucleotide"
ucauccaugaacuucaccacuuc

SEQ ID NO: 3418 - RNA, 23 nt, Artificial Sequence
  source: /note="Description of Artificial Sequence: Synthetic oligonucleotide"
uacauccaugaacuucaccacuu

SEQ ID NO: 3419 - RNA, 23 nt, Artificial Sequence
  source: /note="Description of Artificial Sequence: Synthetic oligonucleotide"
uagacauccaugaacuucaccac

SEQ ID NO: 3420 - RNA, 23 nt, Artificial Sequence
  source: /note="Description of Artificial Sequence: Synthetic oligonucleotide"
uuagacauccaugaacuucacca

SEQ ID NO: 3421 - RNA, 23 nt, Artificial Sequence
  source: /note="Description of Artificial Sequence: Synthetic oligonucleotide"
uauagacauccaugaacuucacc

SEQ ID NO: 3422 - RNA, 23 nt, Artificial Sequence
  source: /note="Description of Artificial Sequence: Synthetic oligonucleotide"
uugauagacauccaugaacuuca

SEQ ID NO: 3423 - RNA, 23 nt, Artificial Sequence
  source: /note="Description of Artificial Sequence: Synthetic oligonucleotide"
ucugauagacauccaugaacuuc

SEQ ID NO: 3424 - RNA, 23 nt, Artificial Sequence
  source: /note="Description of Artificial Sequence: Synthetic oligonucleotide"
ucgcugauagacauccaugaacu

SEQ ID NO: 3425 - RNA, 23 nt, Artificial Sequence
  source: /note="Description of Artificial Sequence: Synthetic oligonucleotide"
uuacuccuggaagauguccacca

SEQ ID NO: 3426 - RNA, 23 nt, Artificial Sequence
  source: /note="Description of Artificial Sequence: Synthetic oligonucleotide"
uuggcuugaagauguacucgauc

SEQ ID NO: 3427 - RNA, 23 nt, Artificial Sequence
  source: /note="Description of Artificial Sequence: Synthetic oligonucleotide"
uauggcuugaagauguacucgau

SEQ ID NO: 3428 - RNA, 23 nt, Artificial Sequence
  source: /note="Description of Artificial Sequence: Synthetic oligonucleotide"
ugauggcuugaagauguacucga

SEQ ID NO: 3429 - RNA, 23 nt, Artificial Sequence
  source: /note="Description of Artificial Sequence: Synthetic oligonucleotide"
uaggauggcuugaagauguacuc

SEQ ID NO: 3430 - RNA, 23 nt, Artificial Sequence
  source: /note="Description of Artificial Sequence: Synthetic oligonucleotide"
uaaucugcauggugauguuggac

SEQ ID NO: 3431 - RNA, 23 nt, Artificial Sequence
  source: /note="Description of Artificial Sequence: Synthetic oligonucleotide"
uuaaucugcauggugauguugga

SEQ ID NO: 3432 - RNA, 23 nt, Artificial Sequence
  source: /note="Description of Artificial Sequence: Synthetic oligonucleotide"
ucauaaucugcauggugauguug

SEQ ID NO: 3433 - RNA, 23 nt, Artificial Sequence
  source: /note="Description of Artificial Sequence: Synthetic oligonucleotide"
ugcauaaucugcauggugauguu

SEQ ID NO: 3434 - RNA, 23 nt, Artificial Sequence
  source: /note="Description of Artificial Sequence: Synthetic oligonucleotide"
uauccgcauaaucugcaugguga

SEQ ID NO: 3435 - RNA, 23 nt, Artificial Sequence
  source: /note="Description of Artificial Sequence: Synthetic oligonucleotide"
uuugauccgcauaaucugcaugg

SEQ ID NO: 3436 - RNA, 23 nt, Artificial Sequence
  source: /note="Description of Artificial Sequence: Synthetic oligonucleotide"
uuuugauccgcauaaucugcaug

SEQ ID NO: 3437 - RNA, 23 nt, Artificial Sequence
  source: /note="Description of Artificial Sequence: Synthetic oligonucleotide"
uguuugauccgcauaaucugcau

SEQ ID NO: 3438 - RNA, 23 nt, Artificial Sequence
  source: /note="Description of Artificial Sequence: Synthetic oligonucleotide"
ugagguuugauccgcauaaucug

SEQ ID NO: 3439 - RNA, 23 nt, Artificial Sequence
  source: /note="Description of Artificial Sequence: Synthetic oligonucleotide"
uugagguuugauccgcauaaucu

SEQ ID NO: 3440 - RNA, 23 nt, Artificial Sequence
  source: /note="Description of Artificial Sequence: Synthetic oligonucleotide"
uccuuggugagguuugauccgca

SEQ ID NO: 3441 - RNA, 23 nt, Artificial Sequence
  source: /note="Description of Artificial Sequence: Synthetic oligonucleotide"
uuguaggaagcucaucucuccua

SEQ ID NO: 3442 - RNA, 23 nt, Artificial Sequence
  source: /note="Description of Artificial Sequence: Synthetic oligonucleotide"
uugcuguaggaagcucaucucuc

SEQ ID NO: 3443 - RNA, 23 nt, Artificial Sequence
  source: /note="Description of Artificial Sequence: Synthetic oligonucleotide"
uugugcuguaggaagcucaucuc

SEQ ID NO: 3444 - RNA, 23 nt, Artificial Sequence
  source: /note="Description of Artificial Sequence: Synthetic oligonucleotide"
uuugugcuguaggaagcucaucu

SEQ ID NO: 3445 - RNA, 23 nt, Artificial Sequence
  source: /note="Description of Artificial Sequence: Synthetic oligonucleotide"
uuguugugcuguaggaagcucau

SEQ ID NO: 3446 - RNA, 23 nt, Artificial Sequence
  source: /note="Description of Artificial Sequence: Synthetic oligonucleotide"
uuuguugugcuguaggaagcuca

SEQ ID NO: 3447 - RNA, 23 nt, Artificial Sequence
  source: /note="Description of Artificial Sequence: Synthetic oligonucleotide"
uuuuguugugcuguaggaagcuc

SEQ ID NO: 3448 - RNA, 23 nt, Artificial Sequence
  source: /note="Description of Artificial Sequence: Synthetic oligonucleotide"
uauuuguugugcuguaggaagcu

SEQ ID NO: 3449 - RNA, 23 nt, Artificial Sequence
  source: /note="Description of Artificial Sequence: Synthetic oligonucleotide"
uacauuuguugugcuguaggaag

SEQ ID NO: 3450 - RNA, 23 nt, Artificial Sequence
  source: /note="Description of Artificial Sequence: Synthetic oligonucleotide"
uucacauuuguugugcuguagga

SEQ ID NO: 3451 - RNA, 23 nt, Artificial Sequence
  source: /note="Description of Artificial Sequence: Synthetic oligonucleotide"
uuucacauuuguugugcuguagg

SEQ ID NO: 3452 - RNA, 23 nt, Artificial Sequence
  source: /note="Description of Artificial Sequence: Synthetic oligonucleotide"
ugcauucacauuuguugugcugu

SEQ ID NO: 3453 - RNA, 23 nt, Artificial Sequence
  source: /note="Description of Artificial Sequence: Synthetic oligonucleotide"
uugcauucacauuuguugugcug

SEQ ID NO: 3454 - RNA, 23 nt, Artificial Sequence
  source: /note="Description of Artificial Sequence: Synthetic oligonucleotide"
uuaucagucuuuccuggugagag

SEQ ID NO: 3455 - RNA, 23 nt, Artificial Sequence
  source: /note="Description of Artificial Sequence: Synthetic oligonucleotide"
uguaucagucuuuccuggugaga

SEQ ID NO: 3456 - RNA, 23 nt, Artificial Sequence
  source: /note="Description of Artificial Sequence: Synthetic oligonucleotide"
uuguaucagucuuuccuggugag

SEQ ID NO: 3457 - RNA, 23 nt, Artificial Sequence
  source: /note="Description of Artificial Sequence: Synthetic oligonucleotide"
ucuguaucagucuuuccugguga

SEQ ID NO: 3458 - RNA, 23 nt, Artificial Sequence
  source: /note="Description of Artificial Sequence: Synthetic oligonucleotide"
uucuguaucagucuuuccuggug

SEQ ID NO: 3459 - RNA, 23 nt, Artificial Sequence
  source: /note="Description of Artificial Sequence: Synthetic oligonucleotide"
uuucuguaucagucuuuccuggu

SEQ ID NO: 3460 - RNA, 23 nt, Artificial Sequence
  source: /note="Description of Artificial Sequence: Synthetic oligonucleotide"
uguucuguaucagucuuuccugg

SEQ ID NO: 3461 - RNA, 23 nt, Artificial Sequence
  source: /note="Description of Artificial Sequence: Synthetic oligonucleotide"
ucguucuguaucagucuuuccug

SEQ ID NO: 3462 - RNA, 23 nt, Artificial Sequence
  source: /note="Description of Artificial Sequence: Synthetic oligonucleotide"
uucguucuguaucagucuuuccu

SEQ ID NO: 3463 - RNA, 23 nt, Artificial Sequence
  source: /note="Description of Artificial Sequence: Synthetic oligonucleotide"
uaucguucuguaucagucuuucc

SEQ ID NO: 3464 - RNA, 23 nt, Artificial Sequence
  source: /note="Description of Artificial Sequence: Synthetic oligonucleotide"
ugaucguucuguaucagucuuuc

SEQ ID NO: 3465 - RNA, 23 nt, Artificial Sequence
  source: /note="Description of Artificial Sequence: Synthetic oligonucleotide"
ucgaucguucuguaucagucuuu

SEQ ID NO: 3466 - RNA, 23 nt, Artificial Sequence
  source: /note="Description of Artificial Sequence: Synthetic oligonucleotide"
uucgaucguucuguaucagucuu

SEQ ID NO: 3467 - RNA, 23 nt, Artificial Sequence
  source: /note="Description of Artificial Sequence: Synthetic oligonucleotide"
uaucgaucguucuguaucagucu

SEQ ID NO: 3468 - RNA, 23 nt, Artificial Sequence
  source: /note="Description of Artificial Sequence: Synthetic oligonucleotide"
uuaucgaucguucuguaucaguc

SEQ ID NO: 3469 - RNA, 23 nt, Artificial Sequence
  source: /note="Description of Artificial Sequence: Synthetic oligonucleotide"
uguaucgaucguucuguaucagu

SEQ ID NO: 3470 - RNA, 23 nt, Artificial Sequence
  source: /note="Description of Artificial Sequence: Synthetic oligonucleotide"
uuguaucgaucguucuguaucag

SEQ ID NO: 3471 - RNA, 23 nt, Artificial Sequence
  source: /note="Description of Artificial Sequence: Synthetic oligonucleotide"
ucuguaucgaucguucuguauca

SEQ ID NO: 3472 - RNA, 23 nt, Artificial Sequence
  source: /note="Description of Artificial Sequence: Synthetic oligonucleotide"
uucuguaucgaucguucuguauc

SEQ ID NO: 3473 - RNA, 23 nt, Artificial Sequence
  source: /note="Description of Artificial Sequence: Synthetic oligonucleotide"
uuucuguaucgaucguucuguau

SEQ ID NO: 3474 - RNA, 23 nt, Artificial Sequence
  source: /note="Description of Artificial Sequence: Synthetic oligonucleotide"
uuuucuguaucgaucguucugua

SEQ ID NO: 3475 - RNA, 23 nt, Artificial Sequence
  source: /note="Description of Artificial Sequence: Synthetic oligonucleotide"
uguuucuguaucgaucguucugu

SEQ ID NO: 3476 - RNA, 23 nt, Artificial Sequence
  source: /note="Description of Artificial Sequence: Synthetic oligonucleotide"
ugguuucuguaucgaucguucug

SEQ ID NO: 3477 - RNA, 23 nt, Artificial Sequence
  source: /note="Description of Artificial Sequence: Synthetic oligonucleotide"
uugguuucuguaucgaucguucu

SEQ ID NO: 3478 - RNA, 23 nt, Artificial Sequence
  source: /note="Description of Artificial Sequence: Synthetic oligonucleotide"
ugugguuucuguaucgaucguuc

SEQ ID NO: 3479 - RNA, 23 nt, Artificial Sequence
  source: /note="Description of Artificial Sequence: Synthetic oligonucleotide"
ucgugguuucuguaucgaucguu

SEQ ID NO: 3480 - RNA, 23 nt, Artificial Sequence
  source: /note="Description of Artificial Sequence: Synthetic oligonucleotide"
uuucugucgauggugauggugug

SEQ ID NO: 3481 - RNA, 23 nt, Artificial Sequence
  source: /note="Description of Artificial Sequence: Synthetic oligonucleotide"
ucuguucugucgauggugauggu

SEQ ID NO: 3482 - RNA, 23 nt, Artificial Sequence
  source: /note="Description of Artificial Sequence: Synthetic oligonucleotide"
ugacuguucugucgauggugaug

SEQ ID NO: 3483 - RNA, 23 nt, Artificial Sequence
  source: /note="Description of Artificial Sequence: Synthetic oligonucleotide"
uggacuguucugucgauggugau

SEQ ID NO: 3484 - RNA, 23 nt, Artificial Sequence
  source: /note="Description of Artificial Sequence: Synthetic oligonucleotide"
uaggacuguucugucgaugguga

SEQ ID NO: 3485 - RNA, 23 nt, Artificial Sequence
  source: /note="Description of Artificial Sequence: Synthetic oligonucleotide"
uaaggacuguucugucgauggug

SEQ ID NO: 3486 - RNA, 23 nt, Artificial Sequence
  source: /note="Description of Artificial Sequence: Synthetic oligonucleotide"
uuaaggacuguucugucgauggu

SEQ ID NO: 3487 - RNA, 23 nt, Artificial Sequence
  source: /note="Description of Artificial Sequence: Synthetic oligonucleotide"
uuuaaggacuguucugucgaugg

SEQ ID NO: 3488 - RNA, 23 nt, Artificial Sequence
  source: /note="Description of Artificial Sequence: Synthetic oligonucleotide"
uauuaaggacuguucugucgaug

SEQ ID NO: 3489 - RNA, 23 nt, Artificial Sequence
  source: /note="Description of Artificial Sequence: Synthetic oligonucleotide"
ugauuaaggacuguucugucgau

SEQ ID NO: 3490 - RNA, 23 nt, Artificial Sequence
  source: /note="Description of Artificial Sequence: Synthetic oligonucleotide"
uggauuaaggacuguucugucga

SEQ ID NO: 3491 - RNA, 23 nt, Artificial Sequence
  source: /note="Description of Artificial Sequence: Synthetic oligonucleotide"
uuggauuaaggacuguucugucg

SEQ ID NO: 3492 - RNA, 23 nt, Artificial Sequence
  source: /note="Description of Artificial Sequence: Synthetic oligonucleotide"
uucuggauuaaggacuguucugu

SEQ ID NO: 3493 - RNA, 23 nt, Artificial Sequence
  source: /note="Description of Artificial Sequence: Synthetic oligonucleotide"
uuucuggauuaaggacuguucug

SEQ ID NO: 3494 - RNA, 23 nt, Artificial Sequence
  source: /note="Description of Artificial Sequence: Synthetic oligonucleotide"
uuuucuggauuaaggacuguucu

SEQ ID NO: 3495 - RNA, 23 nt, Artificial Sequence
  source: /note="Description of Artificial Sequence: Synthetic oligonucleotide"
uguuucuggauuaaggacuguuc

SEQ ID NO: 3496 - RNA, 23 nt, Artificial Sequence
  source: /note="Description of Artificial Sequence: Synthetic oligonucleotide"
ugguuucuggauuaaggacuguu

SEQ ID NO: 3497 - RNA, 23 nt, Artificial Sequence
  source: /note="Description of Artificial Sequence: Synthetic oligonucleotide"
uagguuucuggauuaaggacugu

SEQ ID NO: 3498 - RNA, 23 nt, Artificial Sequence
  source: /note="Description of Artificial Sequence: Synthetic oligonucleotide"
ucagguuucuggauuaaggacug

SEQ ID NO: 3499 - RNA, 23 nt, Artificial Sequence
  source: /note="Description of Artificial Sequence: Synthetic oligonucleotide"
uucagguuucuggauuaaggacu

SEQ ID NO: 3500 - RNA, 23 nt, Artificial Sequence
  source: /note="Description of Artificial Sequence: Synthetic oligonucleotide"
uuucagguuucuggauuaaggac

SEQ ID NO: 3501 - RNA, 23 nt, Artificial Sequence
  source: /note="Description of Artificial Sequence: Synthetic oligonucleotide"
uuuucagguuucuggauuaagga

SEQ ID NO: 3502 - RNA, 23 nt, Artificial Sequence
  source: /note="Description of Artificial Sequence: Synthetic oligonucleotide"
uauuucagguuucuggauuaagg

SEQ ID NO: 3503 - RNA, 23 nt, Artificial Sequence
  source: /note="Description of Artificial Sequence: Synthetic oligonucleotide"
uuccuucauuucagguuucugga

SEQ ID NO: 3504 - RNA, 23 nt, Artificial Sequence
  source: /note="Description of Artificial Sequence: Synthetic oligonucleotide"
uuuccuucauuucagguuucugg

SEQ ID NO: 3505 - RNA, 23 nt, Artificial Sequence
  source: /note="Description of Artificial Sequence: Synthetic oligonucleotide"
ucuuccuucauuucagguuucug

SEQ ID NO: 3506 - RNA, 23 nt, Artificial Sequence
  source: /note="Description of Artificial Sequence: Synthetic oligonucleotide"
uucuuccuucauuucagguuucu

SEQ ID NO: 3507 - RNA, 23 nt, Artificial Sequence
  source: /note="Description of Artificial Sequence: Synthetic oligonucleotide"
ucucuuccuucauuucagguuuc

SEQ ID NO: 3508 - RNA, 23 nt, Artificial Sequence
  source: /note="Description of Artificial Sequence: Synthetic oligonucleotide"
uuccucuuccuucauuucagguu

SEQ ID NO: 3509 - RNA, 23 nt, Artificial Sequence
  source: /note="Description of Artificial Sequence: Synthetic oligonucleotide"
uagagucuccucuuccuucauuu

SEQ ID NO: 3510 - RNA, 23 nt, Artificial Sequence
  source: /note="Description of Artificial Sequence: Synthetic oligonucleotide"
ugaauccaauuccaagagggacc

SEQ ID NO: 3511 - RNA, 23 nt, Artificial Sequence
  source: /note="Description of Artificial Sequence: Synthetic oligonucleotide"
ugcgaauccaauuccaagaggga

SEQ ID NO: 3512 - RNA, 23 nt, Artificial Sequence
  source: /note="Description of Artificial Sequence: Synthetic oligonucleotide"
uggcgaauccaauuccaagaggg

SEQ ID NO: 3513 - RNA, 23 nt, Artificial Sequence
  source: /note="Description of Artificial Sequence: Synthetic oligonucleotide"
uaauggcgaauccaauuccaaga

SEQ ID NO: 3514 - RNA, 23 nt, Artificial Sequence
  source: /note="Description of Artificial Sequence: Synthetic oligonucleotide"
uaaauggcgaauccaauuccaag

SEQ ID NO: 3515 - RNA, 23 nt, Artificial Sequence
  source: /note="Description of Artificial Sequence: Synthetic oligonucleotide"
uaaaauggcgaauccaauuccaa

SEQ ID NO: 3516 - RNA, 23 nt, Artificial Sequence
  source: /note="Description of Artificial Sequence: Synthetic oligonucleotide"
uuaaaauggcgaauccaauucca

SEQ ID NO: 3517 - RNA, 23 nt, Artificial Sequence
  source: /note="Description of Artificial Sequence: Synthetic oligonucleotide"
uauaaaauggcgaauccaauucc

SEQ ID NO: 3518 - RNA, 23 nt, Artificial Sequence
  source: /note="Description of Artificial Sequence: Synthetic oligonucleotide"
uaauaaaauggcgaauccaauuc

SEQ ID NO: 3519 - RNA, 23 nt, Artificial Sequence
  source: /note="Description of Artificial Sequence: Synthetic oligonucleotide"
uaaauaaaauggcgaauccaauu

SEQ ID NO: 3520 - RNA, 23 nt, Artificial Sequence
  source: /note="Description of Artificial Sequence: Synthetic oligonucleotide"
uaaaauaaaauggcgaauccaau

SEQ ID NO: 3521 - RNA, 23 nt, Artificial Sequence
  source: /note="Description of Artificial Sequence: Synthetic oligonucleotide"
uaaaaauaaaauggcgaauccaa

SEQ ID NO: 3522 - RNA, 23 nt, Artificial Sequence
  source: /note="Description of Artificial Sequence: Synthetic oligonucleotide"
ugaaaaauaaaauggcgaaucca

SEQ ID NO: 3523 - RNA, 23 nt, Artificial Sequence
  source: /note="Description of Artificial Sequence: Synthetic oligonucleotide"
ucaagaaaaauaaaauggcgaau

SEQ ID NO: 3524 - RNA, 23 nt, Artificial Sequence
  source: /note="Description of Artificial Sequence: Synthetic oligonucleotide"
ugcaagaaaaauaaaauggcgaa

SEQ ID NO: 3525 - RNA, 23 nt, Artificial Sequence
  source: /note="Description of Artificial Sequence: Synthetic oligonucleotide"
uagcaagaaaaauaaaauggcga

SEQ ID NO: 3526 - RNA, 23 nt, Artificial Sequence
  source: /note="Description of Artificial Sequence: Synthetic oligonucleotide"
ucagcaagaaaaauaaaauggcg

SEQ ID NO: 3527 - RNA, 23 nt, Artificial Sequence
  source: /note="Description of Artificial Sequence: Synthetic oligonucleotide"
ugcagcaagaaaaauaaaauggc

SEQ ID NO: 3528 - RNA, 23 nt, Artificial Sequence
  source: /note="Description of Artificial Sequence: Synthetic oligonucleotide"
uagcagcaagaaaaauaaaaugg

SEQ ID NO: 3529 - RNA, 23 nt, Artificial Sequence
  source: /note="Description of Artificial Sequence: Synthetic oligonucleotide"
uuagcagcaagaaaaauaaaaug

SEQ ID NO: 3530 - RNA, 23 nt, Artificial Sequence
  source: /note="Description of Artificial Sequence: Synthetic oligonucleotide"
uggugauuuagcagcaagaaaaa

SEQ ID NO: 3531 - RNA, 23 nt, Artificial Sequence
  source: /note="Description of Artificial Sequence: Synthetic oligonucleotide"
uuaaucuuccgggcucggugauu

SEQ ID NO: 3532 - RNA, 23 nt, Artificial Sequence
  source: /note="Description of Artificial Sequence: Synthetic oligonucleotide"
uaacucucuaaucuuccgggcuc

SEQ ID NO: 3533 - RNA, 23 nt, Artificial Sequence
  source: /note="Description of Artificial Sequence: Synthetic oligonucleotide"
uaaacucucuaaucuuccgggcu

SEQ ID NO: 3534 - RNA, 23 nt, Artificial Sequence
  source: /note="Description of Artificial Sequence: Synthetic oligonucleotide"
uuaaaacucucuaaucuuccggg

SEQ ID NO: 3535 - RNA, 23 nt, Artificial Sequence
  source: /note="Description of Artificial Sequence: Synthetic oligonucleotide"
uauaaaacucucuaaucuuccgg

SEQ ID NO: 3536 - RNA, 23 nt, Artificial Sequence
  source: /note="Description of Artificial Sequence: Synthetic oligonucleotide"
uaauaaaacucucuaaucuuccg

SEQ ID NO: 3537 - RNA, 23 nt, Artificial Sequence
  source: /note="Description of Artificial Sequence: Synthetic oligonucleotide"
uaaauaaaacucucuaaucuucc

SEQ ID NO: 3538 - RNA, 23 nt, Artificial Sequence
  source: /note="Description of Artificial Sequence: Synthetic oligonucleotide"
ugaaauaaaacucucuaaucuuc

SEQ ID NO: 3539 - RNA, 23 nt, Artificial Sequence
  source: /note="Description of Artificial Sequence: Synthetic oligonucleotide"
ucagaaauaaaacucucuaaucu

SEQ ID NO: 3540 - RNA, 23 nt, Artificial Sequence
  source: /note="Description of Artificial Sequence: Synthetic oligonucleotide"
uccagaaauaaaacucucuaauc

SEQ ID NO: 3541 - RNA, 23 nt, Artificial Sequence
  source: /note="Description of Artificial Sequence: Synthetic oligonucleotide"
ucccagaaauaaaacucucuaau

SEQ ID NO: 3542 - RNA, 23 nt, Artificial Sequence
  source: /note="Description of Artificial Sequence: Synthetic oligonucleotide"
uucccagaaauaaaacucucuaa

SEQ ID NO: 3543 - RNA, 23 nt, Artificial Sequence
  source: /note="Description of Artificial Sequence: Synthetic oligonucleotide"
uaucccagaaauaaaacucucua

SEQ ID NO: 3544 - RNA, 23 nt, Artificial Sequence
  source: /note="Description of Artificial Sequence: Synthetic oligonucleotide"
uaaucccagaaauaaaacucucu

SEQ ID NO: 3545 - RNA, 23 nt, Artificial Sequence
  source: /note="Description of Artificial Sequence: Synthetic oligonucleotide"
ugaaucccagaaauaaaacucuc

SEQ ID NO: 3546 - RNA, 23 nt, Artificial Sequence
  source: /note="Description of Artificial Sequence: Synthetic oligonucleotide"
uggaaucccagaaauaaaacucu

SEQ ID NO: 3547 - RNA, 23 nt, Artificial Sequence
  source: /note="Description of Artificial Sequence: Synthetic oligonucleotide"
uaggaaucccagaaauaaaacuc

SEQ ID NO: 3548 - RNA, 23 nt, Artificial Sequence
  source: /note="Description of Artificial Sequence: Synthetic oligonucleotide"
ucaggaaucccagaaauaaaacu

SEQ ID NO: 3549 - RNA, 23 nt, Artificial Sequence
  source: /note="Description of Artificial Sequence: Synthetic oligonucleotide"
uacaggaaucccagaaauaaaac

SEQ ID NO: 3550 - RNA, 23 nt, Artificial Sequence
  source: /note="Description of Artificial Sequence: Synthetic oligonucleotide"
uuacaggaaucccagaaauaaaa

SEQ ID NO: 3551 - RNA, 23 nt, Artificial Sequence
  source: /note="Description of Artificial Sequence: Synthetic oligonucleotide"
ucuacaggaaucccagaaauaaa

SEQ ID NO: 3552 - RNA, 23 nt, Artificial Sequence
  source: /note="Description of Artificial Sequence: Synthetic oligonucleotide"
uucuacaggaaucccagaaauaa

SEQ ID NO: 3553 - RNA, 23 nt, Artificial Sequence
  source: /note="Description of Artificial Sequence: Synthetic oligonucleotide"
ugucuacaggaaucccagaaaua

SEQ ID NO: 3554 - RNA, 23 nt, Artificial Sequence
  source: /note="Description of Artificial Sequence: Synthetic oligonucleotide"
ugugucuacaggaaucccagaaa

SEQ ID NO: 3555 - RNA, 23 nt, Artificial Sequence
  source: /note="Description of Artificial Sequence: Synthetic oligonucleotide"
uugugucuacaggaaucccagaa

SEQ ID NO: 3556 - RNA, 23 nt, Artificial Sequence
  source: /note="Description of Artificial Sequence: Synthetic oligonucleotide"
ugugugucuacaggaaucccaga

SEQ ID NO: 3557 - RNA, 23 nt, Artificial Sequence
  source: /note="Description of Artificial Sequence: Synthetic oligonucleotide"
uggugugucuacaggaaucccag

SEQ ID NO: 3558 - RNA, 23 nt, Artificial Sequence
  source: /note="Description of Artificial Sequence: Synthetic oligonucleotide"
uauguaugugggugggugugucu

SEQ ID NO: 3559 - RNA, 23 nt, Artificial Sequence
  source: /note="Description of Artificial Sequence: Synthetic oligonucleotide"
uauguauguaugugggugggugu

SEQ ID NO: 3560 - RNA, 23 nt, Artificial Sequence
  source: /note="Description of Artificial Sequence: Synthetic oligonucleotide"
uaauguauguaugugggugggug

SEQ ID NO: 3561 - RNA, 23 nt, Artificial Sequence
  source: /note="Description of Artificial Sequence: Synthetic oligonucleotide"
uaaauguauguaugugggugggu

SEQ ID NO: 3562 - RNA, 23 nt, Artificial Sequence
  source: /note="Description of Artificial Sequence: Synthetic oligonucleotide"
uuaaauguauguauguggguggg

SEQ ID NO: 3563 - RNA, 23 nt, Artificial Sequence
  source: /note="Description of Artificial Sequence: Synthetic oligonucleotide"
uauauaaauguauguaugugggu

SEQ ID NO: 3564 - RNA, 23 nt, Artificial Sequence
  source: /note="Description of Artificial Sequence: Synthetic oligonucleotide"
uuauauaaauguauguauguggg

SEQ ID NO: 3565 - RNA, 23 nt, Artificial Sequence
  source: /note="Description of Artificial Sequence: Synthetic oligonucleotide"
ucauuagcacuguuaauuuaaaa

SEQ ID NO: 3566 - RNA, 23 nt, Artificial Sequence
  source: /note="Description of Artificial Sequence: Synthetic oligonucleotide"
uacauuagcacuguuaauuuaaa

SEQ ID NO: 3567 - RNA, 23 nt, Artificial Sequence
  source: /note="Description of Artificial Sequence: Synthetic oligonucleotide"
uaacauuagcacuguuaauuuaa

SEQ ID NO: 3568 - RNA, 23 nt, Artificial Sequence
  source: /note="Description of Artificial Sequence: Synthetic oligonucleotide"
uuaacauuagcacuguuaauuua

SEQ ID NO: 3569 - RNA, 23 nt, Artificial Sequence
  source: /note="Description of Artificial Sequence: Synthetic oligonucleotide"
uauaacauuagcacuguuaauuu

SEQ ID NO: 3570 - RNA, 23 nt, Artificial Sequence
  source: /note="Description of Artificial Sequence: Synthetic oligonucleotide"
uaauaacauuagcacuguuaauu

SEQ ID NO: 3571 - RNA, 23 nt, Artificial Sequence
  source: /note="Description of Artificial Sequence: Synthetic oligonucleotide"
ucaauaacauuagcacuguuaau

SEQ ID NO: 3572 - RNA, 23 nt, Artificial Sequence
  source: /note="Description of Artificial Sequence: Synthetic oligonucleotide"
uccaauaacauuagcacuguuaa

SEQ ID NO: 3573 - RNA, 23 nt, Artificial Sequence
  source: /note="Description of Artificial Sequence: Synthetic oligonucleotide"
uaccaauaacauuagcacuguua

SEQ ID NO: 3574 - RNA, 23 nt, Artificial Sequence
  source: /note="Description of Artificial Sequence: Synthetic oligonucleotide"
ucaccaauaacauuagcacuguu

SEQ ID NO: 3575 - RNA, 23 nt, Artificial Sequence
  source: /note="Description of Artificial Sequence: Synthetic oligonucleotide"
ugacaccaauaacauuagcacug

SEQ ID NO: 3576 - RNA, 23 nt, Artificial Sequence
  source: /note="Description of Artificial Sequence: Synthetic oligonucleotide"
uagacaccaauaacauuagcacu

SEQ ID NO: 3577 - RNA, 23 nt, Artificial Sequence
  source: /note="Description of Artificial Sequence: Synthetic oligonucleotide"
uaagacaccaauaacauuagcac

SEQ ID NO: 3578 - RNA, 23 nt, Artificial Sequence
  source: /note="Description of Artificial Sequence: Synthetic oligonucleotide"
ugaagacaccaauaacauuagca

SEQ ID NO: 3579 - RNA, 23 nt, Artificial Sequence
  source: /note="Description of Artificial Sequence: Synthetic oligonucleotide"
uugaagacaccaauaacauuagc

SEQ ID NO: 3580 - RNA, 23 nt, Artificial Sequence
  source: /note="Description of Artificial Sequence: Synthetic oligonucleotide"
ugugaagacaccaauaacauuag

SEQ ID NO: 3581 - RNA, 23 nt, Artificial Sequence
  source: /note="Description of Artificial Sequence: Synthetic oligonucleotide"
uagugaagacaccaauaacauua

SEQ ID NO: 3582 - RNA, 23 nt, Artificial Sequence
  source: /note="Description of Artificial Sequence: Synthetic oligonucleotide"
ucagugaagacaccaauaacauu

SEQ ID NO: 3583 - RNA, 23 nt, Artificial Sequence
  source: /note="Description of Artificial Sequence: Synthetic oligonucleotide"
uccagugaagacaccaauaacau

SEQ ID NO: 3584 - RNA, 23 nt, Artificial Sequence
  source: /note="Description of Artificial Sequence: Synthetic oligonucleotide"
uuccagugaagacaccaauaaca

SEQ ID NO: 3585 - RNA, 23 nt, Artificial Sequence
  source: /note="Description of Artificial Sequence: Synthetic oligonucleotide"
uuacauccagugaagacaccaau

SEQ ID NO: 3586 - RNA, 23 nt, Artificial Sequence
  source: /note="Description of Artificial Sequence: Synthetic oligonucleotide"
uaaauacauccagugaagacacc

SEQ ID NO: 3587 - RNA, 23 nt, Artificial Sequence
  source: /note="Description of Artificial Sequence: Synthetic oligonucleotide"
ugcagucaaauacauccagugaa

SEQ ID NO: 3588 - RNA, 23 nt, Artificial Sequence
  source: /note="Description of Artificial Sequence: Synthetic oligonucleotide"
uagcagucaaauacauccaguga

SEQ ID NO: 3589 - RNA, 23 nt, Artificial Sequence
  source: /note="Description of Artificial Sequence: Synthetic oligonucleotide"
uacagcagucaaauacauccagu

SEQ ID NO: 3590 - RNA, 23 nt, Artificial Sequence
  source: /note="Description of Artificial Sequence: Synthetic oligonucleotide"
uaaguccacagcagucaaauaca

SEQ ID NO: 3591 - RNA, 23 nt, Artificial Sequence
  source: /note="Description of Artificial Sequence: Synthetic oligonucleotide"
uucaaguccacagcagucaaaua

SEQ ID NO: 3592 - RNA, 23 nt, Artificial Sequence
  source: /note="Description of Artificial Sequence: Synthetic oligonucleotide"
uucccaacucaaguccacagcag

SEQ ID NO: 3593 - RNA, 23 nt, Artificial Sequence
  source: /note="Description of Artificial Sequence: Synthetic oligonucleotide"
ucugucaggaucugagugggaac

SEQ ID NO: 3594 - RNA, 23 nt, Artificial Sequence
  source: /note="Description of Artificial Sequence: Synthetic oligonucleotide"
uccugucaggaucugagugggaa

SEQ ID NO: 3595 - RNA, 23 nt, Artificial Sequence
  source: /note="Description of Artificial Sequence: Synthetic oligonucleotide"
ucagagucucucaucuccuccuc

SEQ ID NO: 3596 - RNA, 23 nt, Artificial Sequence
  source: /note="Description of Artificial Sequence: Synthetic oligonucleotide"
uccagagucucucaucuccuccu

SEQ ID NO: 3597 - RNA, 23 nt, Artificial Sequence
  source: /note="Description of Artificial Sequence: Synthetic oligonucleotide"
uugccagagucucucaucuccuc

SEQ ID NO: 3598 - RNA, 23 nt, Artificial Sequence
  source: /note="Description of Artificial Sequence: Synthetic oligonucleotide"
uaaagaucaugccagagucucuc

SEQ ID NO: 3599 - RNA, 23 nt, Artificial Sequence
  source: /note="Description of Artificial Sequence: Synthetic oligonucleotide"
uaaaagaucaugccagagucucu

SEQ ID NO: 3600 - RNA, 23 nt, Artificial Sequence
  source: /note="Description of Artificial Sequence: Synthetic oligonucleotide"
uguuugucgguguucccaaaacu

SEQ ID NO: 3601 - RNA, 23 nt, Artificial Sequence
  source: /note="Description of Artificial Sequence: Synthetic oligonucleotide"
uacagcaauguccugaagcuccc

SEQ ID NO: 3602 - RNA, 23 nt, Artificial Sequence
  source: /note="Description of Artificial Sequence: Synthetic oligonucleotide"
ugcacagcaauguccugaagcuc

SEQ ID NO: 3603 - RNA, 23 nt, Artificial Sequence
  source: /note="Description of Artificial Sequence: Synthetic oligonucleotide"
uagcacagcaauguccugaagcu

SEQ ID NO: 3604 - RNA, 23 nt, Artificial Sequence
  source: /note="Description of Artificial Sequence: Synthetic oligonucleotide"
uaagcacagcaauguccugaagc

SEQ ID NO: 3605 - RNA, 23 nt, Artificial Sequence
  source: /note="Description of Artificial Sequence: Synthetic oligonucleotide"
uaaagcacagcaauguccugaag

SEQ ID NO: 3606 - RNA, 23 nt, Artificial Sequence
  source: /note="Description of Artificial Sequence: Synthetic oligonucleotide"
ucaaagcacagcaauguccugaa

SEQ ID NO: 3607 - RNA, 23 nt, Artificial Sequence
  source: /note="Description of Artificial Sequence: Synthetic oligonucleotide"
ugaagcaggugagaguaagcgaa

SEQ ID NO: 3608 - RNA, 23 nt, Artificial Sequence
  source: /note="Description of Artificial Sequence: Synthetic oligonucleotide"
uagaagcaggugagaguaagcga

SEQ ID NO: 3609 - RNA, 23 nt, Artificial Sequence
  source: /note="Description of Artificial Sequence: Synthetic oligonucleotide"
uucagaagcaggugagaguaagc

SEQ ID NO: 3610 - RNA, 23 nt, Artificial Sequence
  source: /note="Description of Artificial Sequence: Synthetic oligonucleotide"
uaacucagaagcaggugagagua

SEQ ID NO: 3611 - RNA, 23 nt, Artificial Sequence
  source: /note="Description of Artificial Sequence: Synthetic oligonucleotide"
ucaacucagaagcaggugagagu

SEQ ID NO: 3612 - RNA, 23 nt, Artificial Sequence
  source: /note="Description of Artificial Sequence: Synthetic oligonucleotide"
ugcaacucagaagcaggugagag

SEQ ID NO: 3613 - RNA, 23 nt, Artificial Sequence
  source: /note="Description of Artificial Sequence: Synthetic oligonucleotide"
uggcaacucagaagcaggugaga

SEQ ID NO: 3614 - RNA, 23 nt, Artificial Sequence
  source: /note="Description of Artificial Sequence: Synthetic oligonucleotide"
ugggcaacucagaagcaggugag

SEQ ID NO: 3615 - RNA, 23 nt, Artificial Sequence
  source: /note="Description of Artificial Sequence: Synthetic oligonucleotide"
uugggcaacucagaagcagguga

SEQ ID NO: 3616 - RNA, 23 nt, Artificial Sequence
  source: /note="Description of Artificial Sequence: Synthetic oligonucleotide"
ucugggcaacucagaagcaggug

SEQ ID NO: 3617 - RNA, 23 nt, Artificial Sequence
  source: /note="Description of Artificial Sequence: Synthetic oligonucleotide"
uugugucucuucucuucgccggg

SEQ ID NO: 3618 - RNA, 23 nt, Artificial Sequence
  source: /note="Description of Artificial Sequence: Synthetic oligonucleotide"
uaugugucucuucucuucgccgg

SEQ ID NO: 3619 - RNA, 23 nt, Artificial Sequence
  source: /note="Description of Artificial Sequence: Synthetic oligonucleotide"
uaaugugucucuucucuucgccg

SEQ ID NO: 3620 - RNA, 23 nt, Artificial Sequence
  source: /note="Description of Artificial Sequence: Synthetic oligonucleotide"
ucaaugugucucuucucuucgcc

SEQ ID NO: 3621 - RNA, 23 nt, Artificial Sequence
  source: /note="Description of Artificial Sequence: Synthetic oligonucleotide"
uacaaugugucucuucucuucgc

SEQ ID NO: 3622 - RNA, 23 nt, Artificial Sequence
  source: /note="Description of Artificial Sequence: Synthetic oligonucleotide"
uaacaaugugucucuucucuucg

SEQ ID NO: 3623 - RNA, 23 nt, Artificial Sequence
  source: /note="Description of Artificial Sequence: Synthetic oligonucleotide"
ucaacaaugugucucuucucuuc

SEQ ID NO: 3624 - RNA, 23 nt, Artificial Sequence
  source: /note="Description of Artificial Sequence: Synthetic oligonucleotide"
uccaacaaugugucucuucucuu

SEQ ID NO: 3625 - RNA, 23 nt, Artificial Sequence
  source: /note="Description of Artificial Sequence: Synthetic oligonucleotide"
uuccaacaaugugucucuucucu

SEQ ID NO: 3626 - RNA, 23 nt, Artificial Sequence
  source: /note="Description of Artificial Sequence: Synthetic oligonucleotide"
uuuccaacaaugugucucuucuc

SEQ ID NO: 3627 - RNA, 23 nt, Artificial Sequence
  source: /note="Description of Artificial Sequence: Synthetic oligonucleotide"
ucuuccaacaaugugucucuucu

SEQ ID NO: 3628 - RNA, 23 nt, Artificial Sequence
  source: /note="Description of Artificial Sequence: Synthetic oligonucleotide"
uucuuccaacaaugugucucuuc

SEQ ID NO: 3629 - RNA, 23 nt, Artificial Sequence
  source: /note="Description of Artificial Sequence: Synthetic oligonucleotide"
uuucuuccaacaaugugucucuu

SEQ ID NO: 3630 - RNA, 23 nt, Artificial Sequence
  source: /note="Description of Artificial Sequence: Synthetic oligonucleotide"
ucuucuuccaacaaugugucucu

SEQ ID NO: 3631 - RNA, 23 nt, Artificial Sequence
  source: /note="Description of Artificial Sequence: Synthetic oligonucleotide"
ugcuucuuccaacaaugugucuc

SEQ ID NO: 3632 - RNA, 23 nt, Artificial Sequence
  source: /note="Description of Artificial Sequence: Synthetic oligonucleotide"
uugcuucuuccaacaaugugucu

SEQ ID NO: 3633 - RNA, 23 nt, Artificial Sequence
  source: /note="Description of Artificial Sequence: Synthetic oligonucleotide"
ucugcuucuuccaacaauguguc

SEQ ID NO: 3634 - RNA, 23 nt, Artificial Sequence
  source: /note="Description of Artificial Sequence: Synthetic oligonucleotide"
uuucaauggugugaggacauagg

SEQ ID NO: 3635 - RNA, 23 nt, Artificial Sequence
  source: /note="Description of Artificial Sequence: Synthetic oligonucleotide"
uugguuucaauggugugaggaca

SEQ ID NO: 3636 - RNA, 23 nt, Artificial Sequence
  source: /note="Description of Artificial Sequence: Synthetic oligonucleotide"
ugugguuucaauggugugaggac

SEQ ID NO: 3637 - RNA, 23 nt, Artificial Sequence
  source: /note="Description of Artificial Sequence: Synthetic oligonucleotide"
uagugguuucaauggugugagga

SEQ ID NO: 3638 - RNA, 23 nt, Artificial Sequence
  source: /note="Description of Artificial Sequence: Synthetic oligonucleotide"
uuagugguuucaauggugugagg

SEQ ID NO: 3639 - RNA, 23 nt, Artificial Sequence
  source: /note="Description of Artificial Sequence: Synthetic oligonucleotide"
ucuagugguuucaauggugugag

SEQ ID NO: 3640 - RNA, 23 nt, Artificial Sequence
  source: /note="Description of Artificial Sequence: Synthetic oligonucleotide"
uagaacuagugguuucaauggug

SEQ ID NO: 3641 - RNA, 23 nt, Artificial Sequence
  source: /note="Description of Artificial Sequence: Synthetic oligonucleotide"
ucagaacuagugguuucaauggu

SEQ ID NO: 3642 - RNA, 23 nt, Artificial Sequence
  source: /note="Description of Artificial Sequence: Synthetic oligonucleotide"
uacagaacuagugguuucaaugg

SEQ ID NO: 3643 - RNA, 23 nt, Artificial Sequence
  source: /note="Description of Artificial Sequence: Synthetic oligonucleotide"
ugacagaacuagugguuucaaug

SEQ ID NO: 3644 - RNA, 23 nt, Artificial Sequence
  source: /note="Description of Artificial Sequence: Synthetic oligonucleotide"
uggacagaacuagugguuucaau

SEQ ID NO: 3645 - RNA, 23 nt, Artificial Sequence
  source: /note="Description of Artificial Sequence: Synthetic oligonucleotide"
ucacacacacacaaccaggucuc

SEQ ID NO: 3646 - RNA, 23 nt, Artificial Sequence
  source: /note="Description of Artificial Sequence: Synthetic oligonucleotide"
uucacacacacacaaccaggucu

SEQ ID NO: 3647 - RNA, 23 nt, Artificial Sequence
  source: /note="Description of Artificial Sequence: Synthetic oligonucleotide"
ucucacacacacacaaccagguc

SEQ ID NO: 3648 - RNA, 23 nt, Artificial Sequence
  source: /note="Description of Artificial Sequence: Synthetic oligonucleotide"
uacucacacacacacaaccaggu

SEQ ID NO: 3649 - RNA, 23 nt, Artificial Sequence
  source: /note="Description of Artificial Sequence: Synthetic oligonucleotide"
ucacucacacacacacaaccagg

SEQ ID NO: 3650 - RNA, 23 nt, Artificial Sequence
  source: /note="Description of Artificial Sequence: Synthetic oligonucleotide"
uccacucacacacacacaaccag

SEQ ID NO: 3651 - RNA, 23 nt, Artificial Sequence
  source: /note="Description of Artificial Sequence: Synthetic oligonucleotide"
uucaaccacucacacacacacaa

SEQ ID NO: 3652 - RNA, 23 nt, Artificial Sequence
  source: /note="Description of Artificial Sequence: Synthetic oligonucleotide"
ugucaaccacucacacacacaca

SEQ ID NO: 3653 - RNA, 23 nt, Artificial Sequence
  source: /note="Description of Artificial Sequence: Synthetic oligonucleotide"
uaggucaaccacucacacacaca

SEQ ID NO: 3654 - RNA, 23 nt, Artificial Sequence
  source: /note="Description of Artificial Sequence: Synthetic oligonucleotide"
ugaaggucaaccacucacacaca

SEQ ID NO: 3655 - RNA, 23 nt, Artificial Sequence
  source: /note="Description of Artificial Sequence: Synthetic oligonucleotide"
uggaaggucaaccacucacacac

SEQ ID NO: 3656 - RNA, 23 nt, Artificial Sequence
  source: /note="Description of Artificial Sequence: Synthetic oligonucleotide"
uaggaaggucaaccacucacaca

SEQ ID NO: 3657 - RNA, 23 nt, Artificial Sequence
  source: /note="Description of Artificial Sequence: Synthetic oligonucleotide"
uggaggaaggucaaccacucaca

SEQ ID NO: 3658 - RNA, 23 nt, Artificial Sequence
  source: /note="Description of Artificial Sequence: Synthetic oligonucleotide"
ugauggaggaaggucaaccacuc

SEQ ID NO: 3659 - RNA, 23 nt, Artificial Sequence
  source: /note="Description of Artificial Sequence: Synthetic oligonucleotide"
uucuuuucucugccuccacaaug

SEQ ID NO: 3660 - RNA, 23 nt, Artificial Sequence
  source: /note="Description of Artificial Sequence: Synthetic oligonucleotide"
ucucuuuucucugccuccacaau

SEQ ID NO: 3661 - RNA, 23 nt, Artificial Sequence
  source: /note="Description of Artificial Sequence: Synthetic oligonucleotide"
uucucuuuucucugccuccacaa

SEQ ID NO: 3662 - RNA, 23 nt, Artificial Sequence
  source: /note="Description of Artificial Sequence: Synthetic oligonucleotide"
uuucucuuuucucugccuccaca

SEQ ID NO: 3663 - RNA, 23 nt, Artificial Sequence
  source: /note="Description of Artificial Sequence: Synthetic oligonucleotide"
uuuucucuuuucucugccuccac

SEQ ID NO: 3664 - RNA, 23 nt, Artificial Sequence
  source: /note="Description of Artificial Sequence: Synthetic oligonucleotide"
ucuuucucuuuucucugccucca

SEQ ID NO: 3665 - RNA, 23 nt, Artificial Sequence
  source: /note="Description of Artificial Sequence: Synthetic oligonucleotide"
uacuuucucuuuucucugccucc

SEQ ID NO: 3666 - RNA, 23 nt, Artificial Sequence
  source: /note="Description of Artificial Sequence: Synthetic oligonucleotide"
ucacuuucucuuuucucugccuc

SEQ ID NO: 3667 - RNA, 23 nt, Artificial Sequence
  source: /note="Description of Artificial Sequence: Synthetic oligonucleotide"
uacacuuucucuuuucucugccu

SEQ ID NO: 3668 - RNA, 23 nt, Artificial Sequence
  source: /note="Description of Artificial Sequence: Synthetic oligonucleotide"
uaacacuuucucuuuucucugcc

SEQ ID NO: 3669 - RNA, 23 nt, Artificial Sequence
  source: /note="Description of Artificial Sequence: Synthetic oligonucleotide"
uaaacacuuucucuuuucucugc

SEQ ID NO: 3670 - RNA, 23 nt, Artificial Sequence
  source: /note="Description of Artificial Sequence: Synthetic oligonucleotide"
uaaaacacuuucucuuuucucug

SEQ ID NO: 3671 - RNA, 23 nt, Artificial Sequence
  source: /note="Description of Artificial Sequence: Synthetic oligonucleotide"
uuaaaacacuuucucuuuucucu

SEQ ID NO: 3672 - RNA, 23 nt, Artificial Sequence
  source: /note="Description of Artificial Sequence: Synthetic oligonucleotide"
uauaaaacacuuucucuuuucuc

SEQ ID NO: 3673 - RNA, 23 nt, Artificial Sequence
  source: /note="Description of Artificial Sequence: Synthetic oligonucleotide"
uuauaaaacacuuucucuuuucu

SEQ ID NO: 3674 - RNA, 23 nt, Artificial Sequence
  source: /note="Description of Artificial Sequence: Synthetic oligonucleotide"
uauauaaaacacuuucucuuuuc

SEQ ID NO: 3675 - RNA, 23 nt, Artificial Sequence
  source: /note="Description of Artificial Sequence: Synthetic oligonucleotide"
uuauauaaaacacuuucucuuuu

SEQ ID NO: 3676 - RNA, 23 nt, Artificial Sequence
  source: /note="Description of Artificial Sequence: Synthetic oligonucleotide"
uguauauaaaacacuuucucuuu

SEQ ID NO: 3677 - RNA, 23 nt, Artificial Sequence
  source: /note="Description of Artificial Sequence: Synthetic oligonucleotide"
ucguauauaaaacacuuucucuu

SEQ ID NO: 3678 - RNA, 23 nt, Artificial Sequence
  source: /note="Description of Artificial Sequence: Synthetic oligonucleotide"
uccguauauaaaacacuuucucu

SEQ ID NO: 3679 - RNA, 23 nt, Artificial Sequence
  source: /note="Description of Artificial Sequence: Synthetic oligonucleotide"
uuaccguauauaaaacacuuucu

SEQ ID NO: 3680 - RNA, 23 nt, Artificial Sequence
  source: /note="Description of Artificial Sequence: Synthetic oligonucleotide"
uguaccguauauaaaacacuuuc

SEQ ID NO: 3681 - RNA, 23 nt, Artificial Sequence
  source: /note="Description of Artificial Sequence: Synthetic oligonucleotide"
uaguaccguauauaaaacacuuu

SEQ ID NO: 3682 - RNA, 23 nt, Artificial Sequence
  source: /note="Description of Artificial Sequence: Synthetic oligonucleotide"
uaaguaccguauauaaaacacuu

SEQ ID NO: 3683 - RNA, 23 nt, Artificial Sequence
  source: /note="Description of Artificial Sequence: Synthetic oligonucleotide"
uuaaguaccguauauaaaacacu

SEQ ID NO: 3684 - RNA, 23 nt, Artificial Sequence
  source: /note="Description of Artificial Sequence: Synthetic oligonucleotide"
uauaaguaccguauauaaaacac

SEQ ID NO: 3685 - RNA, 23 nt, Artificial Sequence
  source: /note="Description of Artificial Sequence: Synthetic oligonucleotide"
uaauaaguaccguauauaaaaca

SEQ ID NO: 3686 - RNA, 23 nt, Artificial Sequence
  source: /note="Description of Artificial Sequence: Synthetic oligonucleotide"
uaaauaaguaccguauauaaaac

SEQ ID NO: 3687 - RNA, 23 nt, Artificial Sequence
  source: /note="Description of Artificial Sequence: Synthetic oligonucleotide"
uuaaauaaguaccguauauaaaa

SEQ ID NO: 3688 - RNA, 23 nt, Artificial Sequence
  source: /note="Description of Artificial Sequence: Synthetic oligonucleotide"
uuuaaauaaguaccguauauaaa

SEQ ID NO: 3689 - RNA, 23 nt, Artificial Sequence
  source: /note="Description of Artificial Sequence: Synthetic oligonucleotide"
uaagggauauuaaauaaguaccg

SEQ ID NO: 3690 - RNA, 23 nt, Artificial Sequence
  source: /note="Description of Artificial Sequence: Synthetic oligonucleotide"
uaaagggauauuaaauaaguacc

SEQ ID NO: 3691 - RNA, 23 nt, Artificial Sequence
  source: /note="Description of Artificial Sequence: Synthetic oligonucleotide"
ugcaaaagauacaucucauaaau

SEQ ID NO: 3692 - RNA, 23 nt, Artificial Sequence
  source: /note="Description of Artificial Sequence: Synthetic oligonucleotide"
uagcaaaagauacaucucauaaa

SEQ ID NO: 3693 - RNA, 23 nt, Artificial Sequence
  source: /note="Description of Artificial Sequence: Synthetic oligonucleotide"
ugagcaaaagauacaucucauaa

SEQ ID NO: 3694 - RNA, 23 nt, Artificial Sequence
  source: /note="Description of Artificial Sequence: Synthetic oligonucleotide"
uagagcaaaagauacaucucaua

SEQ ID NO: 3695 - RNA, 23 nt, Artificial Sequence
  source: /note="Description of Artificial Sequence: Synthetic oligonucleotide"
ugagagcaaaagauacaucucau

SEQ ID NO: 3696 - RNA, 23 nt, Artificial Sequence
  source: /note="Description of Artificial Sequence: Synthetic oligonucleotide"
uagagagcaaaagauacaucuca

SEQ ID NO: 3697 - RNA, 23 nt, Artificial Sequence
  source: /note="Description of Artificial Sequence: Synthetic oligonucleotide"
ugagagagcaaaagauacaucuc

SEQ ID NO: 3698 - RNA, 23 nt, Artificial Sequence
  source: /note="Description of Artificial Sequence: Synthetic oligonucleotide"
uagagagagcaaaagauacaucu

SEQ ID NO: 3699 - RNA, 23 nt, Artificial Sequence
  source: /note="Description of Artificial Sequence: Synthetic oligonucleotide"
uauaagagagcaagagagagcaa

SEQ ID NO: 3700 - RNA, 23 nt, Artificial Sequence
  source: /note="Description of Artificial Sequence: Synthetic oligonucleotide"
uaauaagagagcaagagagagca

SEQ ID NO: 3701 - RNA, 23 nt, Artificial Sequence
  source: /note="Description of Artificial Sequence: Synthetic oligonucleotide"
uaaauaagagagcaagagagagc

SEQ ID NO: 3702 - RNA, 23 nt, Artificial Sequence
  source: /note="Description of Artificial Sequence: Synthetic oligonucleotide"
ucaaauaagagagcaagagagag

SEQ ID NO: 3703 - RNA, 23 nt, Artificial Sequence
  source: /note="Description of Artificial Sequence: Synthetic oligonucleotide"
uacaaauaagagagcaagagaga

SEQ ID NO: 3704 - RNA, 23 nt, Artificial Sequence
  source: /note="Description of Artificial Sequence: Synthetic oligonucleotide"
uuacaaauaagagagcaagagag

SEQ ID NO: 3705 - RNA, 23 nt, Artificial Sequence
  source: /note="Description of Artificial Sequence: Synthetic oligonucleotide"
uguacaaauaagagagcaagaga

SEQ ID NO: 3706 - RNA, 23 nt, Artificial Sequence
  source: /note="Description of Artificial Sequence: Synthetic oligonucleotide"
ugguacaaauaagagagcaagag

SEQ ID NO: 3707 - RNA, 23 nt, Artificial Sequence
  source: /note="Description of Artificial Sequence: Synthetic oligonucleotide"
ucgguacaaauaagagagcaaga

SEQ ID NO: 3708 - RNA, 23 nt, Artificial Sequence
  source: /note="Description of Artificial Sequence: Synthetic oligonucleotide"
uccgguacaaauaagagagcaag

SEQ ID NO: 3709 - RNA, 23 nt, Artificial Sequence
  source: /note="Description of Artificial Sequence: Synthetic oligonucleotide"
uaaccgguacaaauaagagagca

SEQ ID NO: 3710 - RNA, 23 nt, Artificial Sequence
  source: /note="Description of Artificial Sequence: Synthetic oligonucleotide"
uaaaccgguacaaauaagagagc

SEQ ID NO: 3711 - RNA, 23 nt, Artificial Sequence
  source: /note="Description of Artificial Sequence: Synthetic oligonucleotide"
uaaaaccgguacaaauaagagag

SEQ ID NO: 3712 - RNA, 23 nt, Artificial Sequence
  source: /note="Description of Artificial Sequence: Synthetic oligonucleotide"
uaaaaaccgguacaaauaagaga

SEQ ID NO: 3713 - RNA, 23 nt, Artificial Sequence
  source: /note="Description of Artificial Sequence: Synthetic oligonucleotide"
ucaaaaaccgguacaaauaagag

SEQ ID NO: 3714 - RNA, 23 nt, Artificial Sequence
  source: /note="Description of Artificial Sequence: Synthetic oligonucleotide"
uacaaaaaccgguacaaauaaga

SEQ ID NO: 3715 - RNA, 23 nt, Artificial Sequence
  source: /note="Description of Artificial Sequence: Synthetic oligonucleotide"
uuacaaaaaccgguacaaauaag

SEQ ID NO: 3716 - RNA, 23 nt, Artificial Sequence
  source: /note="Description of Artificial Sequence: Synthetic oligonucleotide"
uauacaaaaaccgguacaaauaa

SEQ ID NO: 3717 - RNA, 23 nt, Artificial Sequence
  source: /note="Description of Artificial Sequence: Synthetic oligonucleotide"
uuauacaaaaaccgguacaaaua

SEQ ID NO: 3718 - RNA, 23 nt, Artificial Sequence
  source: /note="Description of Artificial Sequence: Synthetic oligonucleotide"
uauauacaaaaaccgguacaaau

SEQ ID NO: 3719 - RNA, 23 nt, Artificial Sequence
  source: /note="Description of Artificial Sequence: Synthetic oligonucleotide"
uuauauacaaaaaccgguacaaa

SEQ ID NO: 3720 - RNA, 23 nt, Artificial Sequence
  source: /note="Description of Artificial Sequence: Synthetic oligonucleotide"
uuuauauacaaaaaccgguacaa

SEQ ID NO: 3721 - RNA, 23 nt, Artificial Sequence
  source: /note="Description of Artificial Sequence: Synthetic oligonucleotide"
uuuuauauacaaaaaccgguaca

SEQ ID NO: 3722 - RNA, 23 nt, Artificial Sequence
  source: /note="Description of Artificial Sequence: Synthetic oligonucleotide"
uuuuuauauacaaaaaccgguac

SEQ ID NO: 3723 - RNA, 23 nt, Artificial Sequence
  source: /note="Description of Artificial Sequence: Synthetic oligonucleotide"
ugagagauuggaaacaugaauuu

SEQ ID NO: 3724 - RNA, 23 nt, Artificial Sequence
  source: /note="Description of Artificial Sequence: Synthetic oligonucleotide"
uagagagauuggaaacaugaauu

SEQ ID NO: 3725 - RNA, 23 nt, Artificial Sequence
  source: /note="Description of Artificial Sequence: Synthetic oligonucleotide"
ugagagagauuggaaacaugaau

SEQ ID NO: 3726 - RNA, 23 nt, Artificial Sequence
  source: /note="Description of Artificial Sequence: Synthetic oligonucleotide"
uagagagagauuggaaacaugaa

SEQ ID NO: 3727 - RNA, 23 nt, Artificial Sequence
  source: /note="Description of Artificial Sequence: Synthetic oligonucleotide"
ugagagagagauuggaaacauga

SEQ ID NO: 3728 - RNA, 23 nt, Artificial Sequence
  source: /note="Description of Artificial Sequence: Synthetic oligonucleotide"
uggagagagagauuggaaacaug

SEQ ID NO: 3729 - RNA, 23 nt, Artificial Sequence
  source: /note="Description of Artificial Sequence: Synthetic oligonucleotide"
uagggagagagagauuggaaaca

SEQ ID NO: 3730 - RNA, 23 nt, Artificial Sequence
  source: /note="Description of Artificial Sequence: Synthetic oligonucleotide"
uucagggagagagagauuggaaa

SEQ ID NO: 3731 - RNA, 23 nt, Artificial Sequence
  source: /note="Description of Artificial Sequence: Synthetic oligonucleotide"
uuaagcuagugacugucaccgau

SEQ ID NO: 3732 - RNA, 23 nt, Artificial Sequence
  source: /note="Description of Artificial Sequence: Synthetic oligonucleotide"
uauaagcuagugacugucaccga

SEQ ID NO: 3733 - RNA, 23 nt, Artificial Sequence
  source: /note="Description of Artificial Sequence: Synthetic oligonucleotide"
uuucaagauaagcuagugacugu

SEQ ID NO: 3734 - RNA, 23 nt, Artificial Sequence
  source: /note="Description of Artificial Sequence: Synthetic oligonucleotide"
uguucaagauaagcuagugacug

SEQ ID NO: 3735 - RNA, 23 nt, Artificial Sequence
  source: /note="Description of Artificial Sequence: Synthetic oligonucleotide"
uuguucaagauaagcuagugacu

SEQ ID NO: 3736 - RNA, 23 nt, Artificial Sequence
  source: /note="Description of Artificial Sequence: Synthetic oligonucleotide"
uucuguucaagauaagcuaguga

SEQ ID NO: 3737 - RNA, 23 nt, Artificial Sequence
  source: /note="Description of Artificial Sequence: Synthetic oligonucleotide"
uaucuguucaagauaagcuagug

SEQ ID NO: 3738 - RNA, 23 nt, Artificial Sequence
  source: /note="Description of Artificial Sequence: Synthetic oligonucleotide"
uuaucuguucaagauaagcuagu

SEQ ID NO: 3739 - RNA, 23 nt, Artificial Sequence
  source: /note="Description of Artificial Sequence: Synthetic oligonucleotide"
uauaucuguucaagauaagcuag

SEQ ID NO: 3740 - RNA, 23 nt, Artificial Sequence
  source: /note="Description of Artificial Sequence: Synthetic oligonucleotide"
uaauaucuguucaagauaagcua

SEQ ID NO: 3741 - RNA, 23 nt, Artificial Sequence
  source: /note="Description of Artificial Sequence: Synthetic oligonucleotide"
uuuucaaaggaaugugugcuggg

SEQ ID NO: 3742 - RNA, 23 nt, Artificial Sequence
  source: /note="Description of Artificial Sequence: Synthetic oligonucleotide"
uauuucaaaggaaugugugcugg

SEQ ID NO: 3743 - RNA, 23 nt, Artificial Sequence
  source: /note="Description of Artificial Sequence: Synthetic oligonucleotide"
uuauuucaaaggaaugugugcug

SEQ ID NO: 3744 - RNA, 23 nt, Artificial Sequence
  source: /note="Description of Artificial Sequence: Synthetic oligonucleotide"
uuuauuucaaaggaaugugugcu

SEQ ID NO: 3745 - RNA, 23 nt, Artificial Sequence
  source: /note="Description of Artificial Sequence: Synthetic oligonucleotide"
uccuuauuucaaaggaaugugug

SEQ ID NO: 3746 - RNA, 23 nt, Artificial Sequence
  source: /note="Description of Artificial Sequence: Synthetic oligonucleotide"
uugaaaccuuauuucaaaggaau

SEQ ID NO: 3747 - RNA, 23 nt, Artificial Sequence
  source: /note="Description of Artificial Sequence: Synthetic oligonucleotide"
uauugaaaccuuauuucaaagga

SEQ ID NO: 3748 - RNA, 23 nt, Artificial Sequence
  source: /note="Description of Artificial Sequence: Synthetic oligonucleotide"
uuauugaaaccuuauuucaaagg

SEQ ID NO: 3749 - RNA, 23 nt, Artificial Sequence
  source: /note="Description of Artificial Sequence: Synthetic oligonucleotide"
uguagauguauauugaaaccuua

SEQ ID NO: 3750 - RNA, 23 nt, Artificial Sequence
  source: /note="Description of Artificial Sequence: Synthetic oligonucleotide"
uuguagauguauauugaaaccuu

SEQ ID NO: 3751 - RNA, 23 nt, Artificial Sequence
  source: /note="Description of Artificial Sequence: Synthetic oligonucleotide"
uauguagauguauauugaaaccu

SEQ ID NO: 3752 - RNA, 23 nt, Artificial Sequence
  source: /note="Description of Artificial Sequence: Synthetic oligonucleotide"
uuauguagauguauauugaaacc

SEQ ID NO: 3753 - RNA, 23 nt, Artificial Sequence
  source: /note="Description of Artificial Sequence: Synthetic oligonucleotide"
uguauguagauguauauugaaac

SEQ ID NO: 3754 - RNA, 23 nt, Artificial Sequence
  source: /note="Description of Artificial Sequence: Synthetic oligonucleotide"
ucaaauacaaguugccaaauaua

SEQ ID NO: 3755 - RNA, 23 nt, Artificial Sequence
  source: /note="Description of Artificial Sequence: Synthetic oligonucleotide"
ucacaaauacaaguugccaaaua

SEQ ID NO: 3756 - RNA, 23 nt, Artificial Sequence
  source: /note="Description of Artificial Sequence: Synthetic oligonucleotide"
ucacacaaauacaaguugccaaa

SEQ ID NO: 3757 - RNA, 23 nt, Artificial Sequence
  source: /note="Description of Artificial Sequence: Synthetic oligonucleotide"
uacacacaaauacaaguugccaa

SEQ ID NO: 3758 - RNA, 23 nt, Artificial Sequence
  source: /note="Description of Artificial Sequence: Synthetic oligonucleotide"
uuacacacaaauacaaguugcca

SEQ ID NO: 3759 - RNA, 23 nt, Artificial Sequence
  source: /note="Description of Artificial Sequence: Synthetic oligonucleotide"
uauacacacaaauacaaguugcc

SEQ ID NO: 3760 - RNA, 23 nt, Artificial Sequence
  source: /note="Description of Artificial Sequence: Synthetic oligonucleotide"
uuauacacacaaauacaaguugc

SEQ ID NO: 3761 - RNA, 23 nt, Artificial Sequence
  source: /note="Description of Artificial Sequence: Synthetic oligonucleotide"
uauauacacacaaauacaaguug

SEQ ID NO: 3762 - RNA, 23 nt, Artificial Sequence
  source: /note="Description of Artificial Sequence: Synthetic oligonucleotide"
ucaaugucuauuuuaucagaauc

SEQ ID NO: 3763 - RNA, 23 nt, Artificial Sequence
  source: /note="Description of Artificial Sequence: Synthetic oligonucleotide"
uuagcaaugucuauuuuaucaga

SEQ ID NO: 3764 - RNA, 23 nt, Artificial Sequence
  source: /note="Description of Artificial Sequence: Synthetic oligonucleotide"
uauagcaaugucuauuuuaucag

SEQ ID NO: 3765 - RNA, 23 nt, Artificial Sequence
  source: /note="Description of Artificial Sequence: Synthetic oligonucleotide"
ugaauagcaaugucuauuuuauc

SEQ ID NO: 3766 - RNA, 23 nt, Artificial Sequence
  source: /note="Description of Artificial Sequence: Synthetic oligonucleotide"
uaaacagaauagcaaugucuauu

SEQ ID NO: 3767 - RNA, 23 nt, Artificial Sequence
  source: /note="Description of Artificial Sequence: Synthetic oligonucleotide"
uaaaacagaauagcaaugucuau

SEQ ID NO: 3768 - RNA, 23 nt, Artificial Sequence
  source: /note="Description of Artificial Sequence: Synthetic oligonucleotide"
uagagagauuuaguauguagaau

SEQ ID NO: 3769 - RNA, 23 nt, Artificial Sequence
  source: /note="Description of Artificial Sequence: Synthetic oligonucleotide"
ugagagagauuuaguauguagaa

SEQ ID NO: 3770 - RNA, 23 nt, Artificial Sequence
  source: /note="Description of Artificial Sequence: Synthetic oligonucleotide"
uggagagagauuuaguauguaga

SEQ ID NO: 3771 - RNA, 23 nt, Artificial Sequence
  source: /note="Description of Artificial Sequence: Synthetic oligonucleotide"
uaggagagagauuuaguauguag

SEQ ID NO: 3772 - RNA, 23 nt, Artificial Sequence
  source: /note="Description of Artificial Sequence: Synthetic oligonucleotide"
uaaggagagagauuuaguaugua

SEQ ID NO: 3773 - RNA, 23 nt, Artificial Sequence
  source: /note="Description of Artificial Sequence: Synthetic oligonucleotide"
uaaaggagagagauuuaguaugu

SEQ ID NO: 3774 - RNA, 23 nt, Artificial Sequence
  source: /note="Description of Artificial Sequence: Synthetic oligonucleotide"
uaaaaggagagagauuuaguaug

SEQ ID NO: 3775 - RNA, 23 nt, Artificial Sequence
  source: /note="Description of Artificial Sequence: Synthetic oligonucleotide"
uguagcaccaauaaauaaaugau

SEQ ID NO: 3776 - RNA, 23 nt, Artificial Sequence
  source: /note="Description of Artificial Sequence: Synthetic oligonucleotide"
uaguagcaccaauaaauaaauga

SEQ ID NO: 3777 - RNA, 23 nt, Artificial Sequence
  source: /note="Description of Artificial Sequence: Synthetic oligonucleotide"
ucaguagcaccaauaaauaaaug

SEQ ID NO: 3778 - RNA, 23 nt, Artificial Sequence
  source: /note="Description of Artificial Sequence: Synthetic oligonucleotide"
uacaguagcaccaauaaauaaau

SEQ ID NO: 3779 - RNA, 23 nt, Artificial Sequence
  source: /note="Description of Artificial Sequence: Synthetic oligonucleotide"
uaacaguagcaccaauaaauaaa

SEQ ID NO: 3780 - RNA, 23 nt, Artificial Sequence
  source: /note="Description of Artificial Sequence: Synthetic oligonucleotide"
uaaacaguagcaccaauaaauaa

SEQ ID NO: 3781 - RNA, 23 nt, Artificial Sequence
  source: /note="Description of Artificial Sequence: Synthetic oligonucleotide"
uauaaacaguagcaccaauaaau

SEQ ID NO: 3782 - RNA, 23 nt, Artificial Sequence
  source: /note="Description of Artificial Sequence: Synthetic oligonucleotide"
uggauaaacaguagcaccaauaa

SEQ ID NO: 3783 - RNA, 23 nt, Artificial Sequence
  source: /note="Description of Artificial Sequence: Synthetic oligonucleotide"
ucgugauguuaauaucuuuuccc

SEQ ID NO: 3784 - RNA, 23 nt, Artificial Sequence
  source: /note="Description of Artificial Sequence: Synthetic oligonucleotide"
uagagacaaagacgugauguuaa

SEQ ID NO: 3785 - RNA, 23 nt, Artificial Sequence
  source: /note="Description of Artificial Sequence: Synthetic oligonucleotide"
uuagagacaaagacgugauguua

SEQ ID NO: 3786 - RNA, 23 nt, Artificial Sequence
  source: /note="Description of Artificial Sequence: Synthetic oligonucleotide"
uacugcacuagagacaaagacgu

SEQ ID NO: 3787 - RNA, 23 nt, Artificial Sequence
  source: /note="Description of Artificial Sequence: Synthetic oligonucleotide"
uaacugcacuagagacaaagacg

SEQ ID NO: 3788 - RNA, 23 nt, Artificial Sequence
  source: /note="Description of Artificial Sequence: Synthetic oligonucleotide"
uaaacugcacuagagacaaagac

SEQ ID NO: 3789 - RNA, 23 nt, Artificial Sequence
  source: /note="Description of Artificial Sequence: Synthetic oligonucleotide"
uuauguacuacggaauaucucga

SEQ ID NO: 3790 - RNA, 23 nt, Artificial Sequence
  source: /note="Description of Artificial Sequence: Synthetic oligonucleotide"
uauauguacuacggaauaucucg

SEQ ID NO: 3791 - RNA, 23 nt, Artificial Sequence
  source: /note="Description of Artificial Sequence: Synthetic oligonucleotide"
uaauauguacuacggaauaucuc

SEQ ID NO: 3792 - RNA, 23 nt, Artificial Sequence
  source: /note="Description of Artificial Sequence: Synthetic oligonucleotide"
uauaucuguauuucuuugucguu

SEQ ID NO: 3793 - RNA, 23 nt, Artificial Sequence
  source: /note="Description of Artificial Sequence: Synthetic oligonucleotide"
uuauaucuguauuucuuugucgu

SEQ ID NO: 3794 - RNA, 23 nt, Artificial Sequence
  source: /note="Description of Artificial Sequence: Synthetic oligonucleotide"
uauauaucuguauuucuuugucg

SEQ ID NO: 3795 - RNA, 23 nt, Artificial Sequence
  source: /note="Description of Artificial Sequence: Synthetic oligonucleotide"
ugauauaucuguauuucuuuguc

SEQ ID NO: 3796 - RNA, 21 nt, Artificial Sequence
  source: /note="Description of Artificial Sequence: Synthetic oligonucleotide"
aaaagagaaaguguuuuauaa

SEQ ID NO: 3797 - RNA, 21 nt, Artificial Sequence
  source: /note="Description of Artificial Sequence: Synthetic oligonucleotide"
aaaagagaaaguguuuuauaa

SEQ ID NO: 3798 - RNA, 21 nt, Artificial Sequence
  source: /note="Description of Artificial Sequence: Synthetic oligonucleotide"
aaaagagaaaguguuuuauaa

SEQ ID NO: 3799 - RNA, 21 nt, Artificial Sequence
  source: /note="Description of Artificial Sequence: Synthetic oligonucleotide"
aaagacugauacagaacgaua

SEQ ID NO: 3800 - RNA, 21 nt, Artificial Sequence
  source: /note="Description of Artificial Sequence: Synthetic oligonucleotide"
aaagacugauacagaacgaua

SEQ ID NO: 3801 - RNA, 21 nt, Artificial Sequence
  source: /note="Description of Artificial Sequence: Synthetic oligonucleotide"
aaagacugauacagaacgaua

SEQ ID NO: 3802 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagagaaagtguuuuauaua

SEQ ID NO: 3803 - RNA, 21 nt, Artificial Sequence
  source: /note="Description of Artificial Sequence: Synthetic oligonucleotide"
aaagagaaaguguuuuauaua

SEQ ID NO: 3804 - RNA, 21 nt, Artificial Sequence
  source: /note="Description of Artificial Sequence: Synthetic oligonucleotide"
aaagagaaaguguuuuauaua

SEQ ID NO: 3805 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacagugctaauguuauugga

SEQ ID NO: 3806 - RNA, 21 nt, Artificial Sequence
  source: /note="Description of Artificial Sequence: Synthetic oligonucleotide"
aacagugcuaauguuauugga

SEQ ID NO: 3807 - RNA, 21 nt, Artificial Sequence
  source: /note="Description of Artificial Sequence: Synthetic oligonucleotide"
aacagugcuaauguuauugga

SEQ ID NO: 3808 - RNA, 21 nt, Artificial Sequence
  source: /note="Description of Artificial Sequence: Synthetic oligonucleotide"
aacgaucgauacagaaaccaa

SEQ ID NO: 3809 - RNA, 21 nt, Artificial Sequence
  source: /note="Description of Artificial Sequence: Synthetic oligonucleotide"
aacgaucgauacagaaaccaa

SEQ ID NO: 3810 - RNA, 21 nt, Artificial Sequence
  source: /note="Description of Artificial Sequence: Synthetic oligonucleotide"
aacgaucgauacagaaaccaa

SEQ ID NO: 3811 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagacugatacagaacgauca

SEQ ID NO: 3812 - RNA, 21 nt, Artificial Sequence
  source: /note="Description of Artificial Sequence: Synthetic oligonucleotide"
aagacugauacagaacgauca

SEQ ID NO: 3813 - RNA, 21 nt, Artificial Sequence
  source: /note="Description of Artificial Sequence: Synthetic oligonucleotide"
aagacugauacagaacgauca

SEQ ID NO: 3814 - RNA, 21 nt, Artificial Sequence
  source: /note="Description of Artificial Sequence: Synthetic oligonucleotide"
aagagaaaguguuuuauauaa

SEQ ID NO: 3815 - RNA, 21 nt, Artificial Sequence
  source: /note="Description of Artificial Sequence: Synthetic oligonucleotide"
aagagaaaguguuuuauauaa

SEQ ID NO: 3816 - RNA, 21 nt, Artificial Sequence
  source: /note="Description of Artificial Sequence: Synthetic oligonucleotide"
aagagaaaguguuuuauauaa

SEQ ID NO: 3817 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuggautcgccauuuuaua

SEQ ID NO: 3818 - RNA, 21 nt, Artificial Sequence
  source: /note="Description of Artificial Sequence: Synthetic oligonucleotide"
aauuggauucgccauuuuaua

SEQ ID NO: 3819 - RNA, 21 nt, Artificial Sequence
  source: /note="Description of Artificial Sequence: Synthetic oligonucleotide"
aauuggauucgccauuuuaua

SEQ ID NO: 3820 - RNA, 21 nt, Artificial Sequence
  source: /note="Description of Artificial Sequence: Synthetic oligonucleotide"
acagaacaguccuuaauccaa

SEQ ID NO: 3821 - RNA, 21 nt, Artificial Sequence
  source: /note="Description of Artificial Sequence: Synthetic oligonucleotide"
acagaacaguccuuaauccaa

SEQ ID NO: 3822 - RNA, 21 nt, Artificial Sequence
  source: /note="Description of Artificial Sequence: Synthetic oligonucleotide"
acagaacaguccuuaauccaa

SEQ ID NO: 3823 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaguccutaauccagaaaca

SEQ ID NO: 3824 - RNA, 21 nt, Artificial Sequence
  source: /note="Description of Artificial Sequence: Synthetic oligonucleotide"
acaguccuuaauccagaaaca

SEQ ID NO: 3825 - RNA, 21 nt, Artificial Sequence
  source: /note="Description of Artificial Sequence: Synthetic oligonucleotide"
acaguccuuaauccagaaaca

SEQ ID NO: 3826 - RNA, 21 nt, Artificial Sequence
  source: /note="Description of Artificial Sequence: Synthetic oligonucleotide"
accaggaaagacugauacaga

SEQ ID NO: 3827 - RNA, 21 nt, Artificial Sequence
  source: /note="Description of Artificial Sequence: Synthetic oligonucleotide"
accaggaaagacugauacaga

SEQ ID NO: 3828 - RNA, 21 nt, Artificial Sequence
  source: /note="Description of Artificial Sequence: Synthetic oligonucleotide"
accaggaaagacugauacaga

SEQ ID NO: 3829 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accaugcagatuaugcggaua

SEQ ID NO: 3830 - RNA, 21 nt, Artificial Sequence
  source: /note="Description of Artificial Sequence: Synthetic oligonucleotide"
accaugcagauuaugcggaua

SEQ ID NO: 3831 - RNA, 21 nt, Artificial Sequence
  source: /note="Description of Artificial Sequence: Synthetic oligonucleotide"
accaugcagauuaugcggaua

SEQ ID NO: 3832 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaacagucctuaauccagaa

SEQ ID NO: 3833 - RNA, 21 nt, Artificial Sequence
  source: /note="Description of Artificial Sequence: Synthetic oligonucleotide"
agaacaguccuuaauccagaa

SEQ ID NO: 3834 - RNA, 21 nt, Artificial Sequence
  source: /note="Description of Artificial Sequence: Synthetic oligonucleotide"
agaacaguccuuaauccagaa

SEQ ID NO: 3835 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauguaucutuugcucucua

SEQ ID NO: 3836 - RNA, 21 nt, Artificial Sequence
  source: /note="Description of Artificial Sequence: Synthetic oligonucleotide"
agauguaucuuuugcucucua

SEQ ID NO: 3837 - RNA, 21 nt, Artificial Sequence
  source: /note="Description of Artificial Sequence: Synthetic oligonucleotide"
agauguaucuuuugcucucua

SEQ ID NO: 3838 - RNA, 21 nt, Artificial Sequence
  source: /note="Description of Artificial Sequence: Synthetic oligonucleotide"
agauuagagaguuuuauuuca

SEQ ID NO: 3839 - RNA, 21 nt, Artificial Sequence
  source: /note="Description of Artificial Sequence: Synthetic oligonucleotide"
agauuagagaguuuuauuuca

SEQ ID NO: 3840 - RNA, 21 nt, Artificial Sequence
  source: /note="Description of Artificial Sequence: Synthetic oligonucleotide"
agauuagagaguuuuauuuca

SEQ ID NO: 3841 - RNA, 21 nt, Artificial Sequence
  source: /note="Description of Artificial Sequence: Synthetic oligonucleotide"
auacagaacgaucgauacaga

SEQ ID NO: 3842 - RNA, 21 nt, Artificial Sequence
  source: /note="Description of Artificial Sequence: Synthetic oligonucleotide"
auacagaacgaucgauacaga

SEQ ID NO: 3843 - RNA, 21 nt, Artificial Sequence
  source: /note="Description of Artificial Sequence: Synthetic oligonucleotide"
auacagaacgaucgauacaga

SEQ ID NO: 3844 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augcagautatgcggaucaaa

SEQ ID NO: 3845 - RNA, 21 nt, Artificial Sequence
  source: /note="Description of Artificial Sequence: Synthetic oligonucleotide"
augcagauuaugcggaucaaa

SEQ ID NO: 3846 - RNA, 21 nt, Artificial Sequence
  source: /note="Description of Artificial Sequence: Synthetic oligonucleotide"
augcagauuaugcggaucaaa

SEQ ID NO: 3847 - RNA, 21 nt, Artificial Sequence
  source: /note="Description of Artificial Sequence: Synthetic oligonucleotide"
auuggauucgccauuuuauua

SEQ ID NO: 3848 - RNA, 21 nt, Artificial Sequence
  source: /note="Description of Artificial Sequence: Synthetic oligonucleotide"
auuggauucgccauuuuauua

SEQ ID NO: 3849 - RNA, 21 nt, Artificial Sequence
  source: /note="Description of Artificial Sequence: Synthetic oligonucleotide"
auuggauucgccauuuuauua

SEQ ID NO: 3850 - RNA, 21 nt, Artificial Sequence
  source: /note="Description of Artificial Sequence: Synthetic oligonucleotide"
caacaucaccaugcagauuaa

SEQ ID NO: 3851 - RNA, 21 nt, Artificial Sequence
  source: /note="Description of Artificial Sequence: Synthetic oligonucleotide"
caacaucaccaugcagauuaa

SEQ ID NO: 3852 - RNA, 21 nt, Artificial Sequence
  source: /note="Description of Artificial Sequence: Synthetic oligonucleotide"
caacaucaccaugcagauuaa

SEQ ID NO: 3853 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaacagtccuuaauccaga

SEQ ID NO: 3854 - RNA, 21 nt, Artificial Sequence
  source: /note="Description of Artificial Sequence: Synthetic oligonucleotide"
cagaacaguccuuaauccaga

SEQ ID NO: 3855 - RNA, 21 nt, Artificial Sequence
  source: /note="Description of Artificial Sequence: Synthetic oligonucleotide"
cagaacaguccuuaauccaga

SEQ ID NO: 3856 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucaccatgcagauuaugca

SEQ ID NO: 3857 - RNA, 21 nt, Artificial Sequence
  source: /note="Description of Artificial Sequence: Synthetic oligonucleotide"
caucaccaugcagauuaugca

SEQ ID NO: 3858 - RNA, 21 nt, Artificial Sequence
  source: /note="Description of Artificial Sequence: Synthetic oligonucleotide"
caucaccaugcagauuaugca

SEQ ID NO: 3859 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucuuggaatuggauucgca

SEQ ID NO: 3860 - RNA, 21 nt, Artificial Sequence
  source: /note="Description of Artificial Sequence: Synthetic oligonucleotide"
ccucuuggaauuggauucgca

SEQ ID NO: 3861 - RNA, 21 nt, Artificial Sequence
  source: /note="Description of Artificial Sequence: Synthetic oligonucleotide"
ccucuuggaauuggauucgca

SEQ ID NO: 3862 - RNA, 21 nt, Artificial Sequence
  source: /note="Description of Artificial Sequence: Synthetic oligonucleotide"
cuacagcacaacaaaugugaa

SEQ ID NO: 3863 - RNA, 21 nt, Artificial Sequence
  source: /note="Description of Artificial Sequence: Synthetic oligonucleotide"
cuacagcacaacaaaugugaa

SEQ ID NO: 3864 - RNA, 21 nt, Artificial Sequence
  source: /note="Description of Artificial Sequence: Synthetic oligonucleotide"
cuacagcacaacaaaugugaa

SEQ ID NO: 3865 - RNA, 21 nt, Artificial Sequence
  source: /note="Description of Artificial Sequence: Synthetic oligonucleotide"
cugauacagaacgaucgauaa

SEQ ID NO: 3866 - RNA, 21 nt, Artificial Sequence
  source: /note="Description of Artificial Sequence: Synthetic oligonucleotide"
cugauacagaacgaucgauaa

SEQ ID NO: 3867 - RNA, 21 nt, Artificial Sequence
  source: /note="Description of Artificial Sequence: Synthetic oligonucleotide"
cugauacagaacgaucgauaa

SEQ ID NO: 3868 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaagugututauauacggua

SEQ ID NO: 3869 - RNA, 21 nt, Artificial Sequence
  source: /note="Description of Artificial Sequence: Synthetic oligonucleotide"
gaaaguguuuuauauacggua

SEQ ID NO: 3870 - RNA, 21 nt, Artificial Sequence
  source: /note="Description of Artificial Sequence: Synthetic oligonucleotide"
gaaaguguuuuauauacggua

SEQ ID NO: 3871 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagaaagugutuuauauacga

SEQ ID NO: 3872 - RNA, 21 nt, Artificial Sequence
  source: /note="Description of Artificial Sequence: Synthetic oligonucleotide"
gagaaaguguuuuauauacga

SEQ ID NO: 3873 - RNA, 21 nt, Artificial Sequence
  source: /note="Description of Artificial Sequence: Synthetic oligonucleotide"
gagaaaguguuuuauauacga

SEQ ID NO: 3874 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauucgccautuuauuuuuca

SEQ ID NO: 3875 - RNA, 21 nt, Artificial Sequence
  source: /note="Description of Artificial Sequence: Synthetic oligonucleotide"
gauucgccauuuuauuuuuca

SEQ ID NO: 3876 - RNA, 21 nt, Artificial Sequence
  source: /note="Description of Artificial Sequence: Synthetic oligonucleotide"
gauucgccauuuuauuuuuca

SEQ ID NO: 3877 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guccuuaatccagaaaccuga

SEQ ID NO: 3878 - RNA, 21 nt, Artificial Sequence
  source: /note="Description of Artificial Sequence: Synthetic oligonucleotide"
guccuuaauccagaaaccuga

SEQ ID NO: 3879 - RNA, 21 nt, Artificial Sequence
  source: /note="Description of Artificial Sequence: Synthetic oligonucleotide"
guccuuaauccagaaaccuga

SEQ ID NO: 3880 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guguuuuatatacgguacuua

SEQ ID NO: 3881 - RNA, 21 nt, Artificial Sequence
  source: /note="Description of Artificial Sequence: Synthetic oligonucleotide"
guguuuuauauacgguacuua

SEQ ID NO: 3882 - RNA, 21 nt, Artificial Sequence
  source: /note="Description of Artificial Sequence: Synthetic oligonucleotide"
guguuuuauauacgguacuua

SEQ ID NO: 3883 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagacauugctauucuguuua

SEQ ID NO: 3884 - RNA, 21 nt, Artificial Sequence
  source: /note="Description of Artificial Sequence: Synthetic oligonucleotide"
uagacauugcuauucuguuua

SEQ ID NO: 3885 - RNA, 21 nt, Artificial Sequence
  source: /note="Description of Artificial Sequence: Synthetic oligonucleotide"
uagacauugcuauucuguuua

SEQ ID NO: 3886 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utauaaaacactutctcuuuucu

SEQ ID NO: 3887 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utauaaaacactuucucuuuucu

SEQ ID NO: 3888 - RNA, 23 nt, Artificial Sequence
  source: /note="Description of Artificial Sequence: Synthetic oligonucleotide"
uuauaaaacacuuucucuuuucu

SEQ ID NO: 3889 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucgutcuguaucagucuuucc

SEQ ID NO: 3890 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucgutcuguaucagucuuucc

SEQ ID NO: 3891 - RNA, 23 nt, Artificial Sequence
  source: /note="Description of Artificial Sequence: Synthetic oligonucleotide"
uaucguucuguaucagucuuucc

SEQ ID NO: 3892 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauataaaacacutucucuuuuc

SEQ ID NO: 3893 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauataaaacacuuucucuuuuc

SEQ ID NO: 3894 - RNA, 23 nt, Artificial Sequence
  source: /note="Description of Artificial Sequence: Synthetic oligonucleotide"
uauauaaaacacuuucucuuuuc

SEQ ID NO: 3895 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaauaacautagcacuguugg

SEQ ID NO: 3896 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaauaacautagcacuguugg

SEQ ID NO: 3897 - RNA, 23 nt, Artificial Sequence
  source: /note="Description of Artificial Sequence: Synthetic oligonucleotide"
uccaauaacauuagcacuguugg

SEQ ID NO: 3898 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggtuucuguaucgaucguucu

SEQ ID NO: 3899 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggtuucuguaucgaucguucu

SEQ ID NO: 3900 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuggtuucuguaucgaucguucu

SEQ ID NO: 3901 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaucguucugtatcagucuuuc

SEQ ID NO: 3902 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaucguucugtaucagucuuuc

SEQ ID NO: 3903 - RNA, 23 nt, Artificial Sequence
  source: /note="Description of Artificial Sequence: Synthetic oligonucleotide"
ugaucguucuguaucagucuuuc

SEQ ID NO: 3904 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utauauaaaacactutcucuuuu

SEQ ID NO: 3905 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utauauaaaacacuuucucuuuu

SEQ ID NO: 3906 - RNA, 23 nt, Artificial Sequence
  source: /note="Description of Artificial Sequence: Synthetic oligonucleotide"
uuauauaaaacacuuucucuuuu

SEQ ID NO: 3907 - RNA, 23 nt, Artificial Sequence
  source: /note="Description of Artificial Sequence: Synthetic oligonucleotide"
uauaaaauggcgaauccaauucc

SEQ ID NO: 3908 - RNA, 23 nt, Artificial Sequence
  source: /note="Description of Artificial Sequence: Synthetic oligonucleotide"
uauaaaauggcgaauccaauucc

SEQ ID NO: 3909 - RNA, 23 nt, Artificial Sequence
  source: /note="Description of Artificial Sequence: Synthetic oligonucleotide"
uauaaaauggcgaauccaauucc

SEQ ID NO: 3910 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggautaaggactgtucugucg

SEQ ID NO: 3911 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggautaaggacuguucugucg

SEQ ID NO: 3912 - RNA, 23 nt, Artificial Sequence
  source: /note="Description of Artificial Sequence: Synthetic oligonucleotide"
uuggauuaaggacuguucugucg

SEQ ID NO: 3913 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguutcuggautaaggacuguuc

SEQ ID NO: 3914 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguutcuggautaaggacuguuc

SEQ ID NO: 3915 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguutcuggauuaaggacuguuc

SEQ ID NO: 3916 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtatcagucutuccuggugc

SEQ ID NO: 3917 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtatcagucuuuccuggugc

SEQ ID NO: 3918 - RNA, 23 nt, Artificial Sequence
  source: /note="Description of Artificial Sequence: Synthetic oligonucleotide"
ucuguaucagucuuuccuggugc

SEQ ID NO: 3919 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauccgcauaatctgcauggugc

SEQ ID NO: 3920 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauccgcauaatcugcauggugc

SEQ ID NO: 3921 - RNA, 23 nt, Artificial Sequence
  source: /note="Description of Artificial Sequence: Synthetic oligonucleotide"
uauccgcauaaucugcauggugc

SEQ ID NO: 3922 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcuggauuaaggactguucugu

SEQ ID NO: 3923 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcuggauuaaggacuguucugu

SEQ ID NO: 3924 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucuggauuaaggacuguucugu

SEQ ID NO: 3925 - RNA, 23 nt, Artificial Sequence
  source: /note="Description of Artificial Sequence: Synthetic oligonucleotide"
uagagagcaaaagauacaucucg

SEQ ID NO: 3926 - RNA, 23 nt, Artificial Sequence
  source: /note="Description of Artificial Sequence: Synthetic oligonucleotide"
uagagagcaaaagauacaucucg

SEQ ID NO: 3927 - RNA, 23 nt, Artificial Sequence
  source: /note="Description of Artificial Sequence: Synthetic oligonucleotide"
uagagagcaaaagauacaucucg

SEQ ID NO: 3928 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaauaaaactctctaaucuuc

SEQ ID NO: 3929 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaauaaaactcucuaaucuuc

SEQ ID NO: 3930 - RNA, 23 nt, Artificial Sequence
  source: /note="Description of Artificial Sequence: Synthetic oligonucleotide"
ugaaauaaaacucucuaaucuuc

SEQ ID NO: 3931 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtaucgaucgtucuguaucg

SEQ ID NO: 3932 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtaucgaucguucuguaucg

SEQ ID NO: 3933 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtaucgaucguucuguaucg

SEQ ID NO: 3934 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugauccgcataaucugcaugg

SEQ ID NO: 3935 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugauccgcataaucugcaugg

SEQ ID NO: 3936 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuugauccgcauaaucugcaugg

SEQ ID NO: 3937 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaauaaaauggcgaatccaauuc

SEQ ID NO: 3938 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaauaaaauggcgaauccaauuc

SEQ ID NO: 3939 - RNA, 23 nt, Artificial Sequence
  source: /note="Description of Artificial Sequence: Synthetic oligonucleotide"
uaauaaaauggcgaauccaauuc

SEQ ID NO: 3940 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaatcugcauggtgauguuggc

SEQ ID NO: 3941 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaatcugcauggugauguuggc

SEQ ID NO: 3942 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaatcugcauggugauguuggc

SEQ ID NO: 3943 - RNA, 23 nt, Artificial Sequence
  source: /note="Description of Artificial Sequence: Synthetic oligonucleotide"
ucuggauuaaggacuguucuguc

SEQ ID NO: 3944 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuggauuaaggacuguucuguc

SEQ ID NO: 3945 - RNA, 23 nt, Artificial Sequence
  source: /note="Description of Artificial Sequence: Synthetic oligonucleotide"
ucuggauuaaggacuguucuguc

SEQ ID NO: 3946 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcataaucugcatggugauguu

SEQ ID NO: 3947 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcataaucugcauggugauguu

SEQ ID NO: 3948 - RNA, 23 nt, Artificial Sequence
  source: /note="Description of Artificial Sequence: Synthetic oligonucleotide"
ugcauaaucugcauggugauguu

SEQ ID NO: 3949 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcgaatccaatuccaagagggc

SEQ ID NO: 3950 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcgaatccaatuccaagagggc

SEQ ID NO: 3951 - RNA, 23 nt, Artificial Sequence
  source: /note="Description of Artificial Sequence: Synthetic oligonucleotide"
ugcgaauccaauuccaagagggc

SEQ ID NO: 3952 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcacatuugutgtgcuguaggg

SEQ ID NO: 3953 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcacatuugutgugcuguaggg

SEQ ID NO: 3954 - RNA, 23 nt, Artificial Sequence
  source: /note="Description of Artificial Sequence: Synthetic oligonucleotide"
uucacauuuguugugcuguaggg

SEQ ID NO: 3955 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaucgaucgutctgtaucaguc

SEQ ID NO: 3956 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaucgaucgutcuguaucaguc

SEQ ID NO: 3957 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaucgaucguucuguaucaguc

SEQ ID NO: 3958 - RNA, 23 nt, Artificial Sequence
  source: /note="Description of Artificial Sequence: Synthetic oligonucleotide"
uaccguauauaaaacacuuucuc

SEQ ID NO: 3959 - RNA, 23 nt, Artificial Sequence
  source: /note="Description of Artificial Sequence: Synthetic oligonucleotide"
uaccguauauaaaacacuuucuc

SEQ ID NO: 3960 - RNA, 23 nt, Artificial Sequence
  source: /note="Description of Artificial Sequence: Synthetic oligonucleotide"
uaccguauauaaaacacuuucuc

SEQ ID NO: 3961 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucguauauaaaacactuucucuu

SEQ ID NO: 3962 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucguauauaaaacacuuucucuu

SEQ ID NO: 3963 - RNA, 23 nt, Artificial Sequence
  source: /note="Description of Artificial Sequence: Synthetic oligonucleotide"
ucguauauaaaacacuuucucuu

SEQ ID NO: 3964 - RNA, 23 nt, Artificial Sequence
  source: /note="Description of Artificial Sequence: Synthetic oligonucleotide"
ugaaaaauaaaauggcgaauccg

SEQ ID NO: 3965 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaaaauaaaauggcgaauccg

SEQ ID NO: 3966 - RNA, 23 nt, Artificial Sequence
  source: /note="Description of Artificial Sequence: Synthetic oligonucleotide"
ugaaaaauaaaauggcgaauccg

SEQ ID NO: 3967 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaggutucuggatuaaggacug

SEQ ID NO: 3968 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaggutucuggauuaaggacug

SEQ ID NO: 3969 - RNA, 23 nt, Artificial Sequence
  source: /note="Description of Artificial Sequence: Synthetic oligonucleotide"
ucagguuucuggauuaaggacug

SEQ ID NO: 3970 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagtaccguatataaaacacuu

SEQ ID NO: 3971 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagtaccguatauaaaacacuu

SEQ ID NO: 3972 - RNA, 23 nt, Artificial Sequence
  source: /note="Description of Artificial Sequence: Synthetic oligonucleotide"
uaaguaccguauauaaaacacuu

SEQ ID NO: 3973 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaacagaauagcaatgucuauu

SEQ ID NO: 3974 - RNA, 23 nt, Artificial Sequence
  source: /note="Description of Artificial Sequence: Synthetic oligonucleotide"
uaaacagaauagcaaugucuauu

SEQ ID NO: 3975 - RNA, 23 nt, Artificial Sequence
  source: /note="Description of Artificial Sequence: Synthetic oligonucleotide"
uaaacagaauagcaaugucuauu

SEQ ID NO: 3976 - RNA, 21 nt, Artificial Sequence
  source: /note="Description of Artificial Sequence: Synthetic oligonucleotide"
aaaagagaaaguguuuuauaa

SEQ ID NO: 3977 - RNA, 21 nt, Artificial Sequence
  source: /note="Description of Artificial Sequence: Synthetic oligonucleotide"
aaaagagaaaguguuuuauaa

SEQ ID NO: 3978 - RNA, 21 nt, Artificial Sequence
  source: /note="Description of Artificial Sequence: Synthetic oligonucleotide"
aaaagagaaaguguuuuauaa

SEQ ID NO: 3979 - RNA, 21 nt, Artificial Sequence
  source: /note="Description of Artificial Sequence: Synthetic oligonucleotide"
aaagacugauacagaacgaua

SEQ ID NO: 3980 - RNA, 21 nt, Artificial Sequence
  source: /note="Description of Artificial Sequence: Synthetic oligonucleotide"
aaagacugauacagaacgaua

SEQ ID NO: 3981 - RNA, 21 nt, Artificial Sequence
  source: /note="Description of Artificial Sequence: Synthetic oligonucleotide"
aaagacugauacagaacgaua

SEQ ID NO: 3982 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagagaaagtguuuuauaua

SEQ ID NO: 3983 - RNA, 21 nt, Artificial Sequence
  source: /note="Description of Artificial Sequence: Synthetic oligonucleotide"
aaagagaaaguguuuuauaua

SEQ ID NO: 3984 - RNA, 21 nt, Artificial Sequence
  source: /note="Description of Artificial Sequence: Synthetic oligonucleotide"
aaagagaaaguguuuuauaua

SEQ ID NO: 3985 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacagugctaauguuauugga

SEQ ID NO: 3986 - RNA, 21 nt, Artificial Sequence
  source: /note="Description of Artificial Sequence: Synthetic oligonucleotide"
aacagugcuaauguuauugga

SEQ ID NO: 3987 - RNA, 21 nt, Artificial Sequence
  source: /note="Description of Artificial Sequence: Synthetic oligonucleotide"
aacagugcuaauguuauugga

SEQ ID NO: 3988 - RNA, 21 nt, Artificial Sequence
  source: /note="Description of Artificial Sequence: Synthetic oligonucleotide"
aacgaucgauacagaaaccaa

SEQ ID NO: 3989 - RNA, 21 nt, Artificial Sequence
  source: /note="Description of Artificial Sequence: Synthetic oligonucleotide"
aacgaucgauacagaaaccaa

SEQ ID NO: 3990 - RNA, 21 nt, Artificial Sequence
  source: /note="Description of Artificial Sequence: Synthetic oligonucleotide"
aacgaucgauacagaaaccaa

SEQ ID NO: 3991 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagacugatacagaacgauca

SEQ ID NO: 3992 - RNA, 21 nt, Artificial Sequence
  source: /note="Description of Artificial Sequence: Synthetic oligonucleotide"
aagacugauacagaacgauca

SEQ ID NO: 3993 - RNA, 21 nt, Artificial Sequence
  source: /note="Description of Artificial Sequence: Synthetic oligonucleotide"
aagacugauacagaacgauca

SEQ ID NO: 3994 - RNA, 21 nt, Artificial Sequence
  source: /note="Description of Artificial Sequence: Synthetic oligonucleotide"
aagagaaaguguuuuauauaa

SEQ ID NO: 3995 - RNA, 21 nt, Artificial Sequence
  source: /note="Description of Artificial Sequence: Synthetic oligonucleotide"
aagagaaaguguuuuauauaa

SEQ ID NO: 3996 - RNA, 21 nt, Artificial Sequence
  source: /note="Description of Artificial Sequence: Synthetic oligonucleotide"
aagagaaaguguuuuauauaa

SEQ ID NO: 3997 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuggautcgccauuuuaua

SEQ ID NO: 3998 - RNA, 21 nt, Artificial Sequence
  source: /note="Description of Artificial Sequence: Synthetic oligonucleotide"
aauuggauucgccauuuuaua

SEQ ID NO: 3999 - RNA, 21 nt, Artificial Sequence
  source: /note="Description of Artificial Sequence: Synthetic oligonucleotide"
aauuggauucgccauuuuaua

SEQ ID NO: 4000 - RNA, 21 nt, Artificial Sequence
  source: /note="Description of Artificial Sequence: Synthetic oligonucleotide"
acagaacaguccuuaauccaa

SEQ ID NO: 4001 - RNA, 21 nt, Artificial Sequence
  source: /note="Description of Artificial Sequence: Synthetic oligonucleotide"
acagaacaguccuuaauccaa

SEQ ID NO: 4002 - RNA, 21 nt, Artificial Sequence
  source: /note="Description of Artificial Sequence: Synthetic oligonucleotide"
acagaacaguccuuaauccaa

SEQ ID NO: 4003 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaguccutaauccagaaaca

SEQ ID NO: 4004 - RNA, 21 nt, Artificial Sequence
  source: /note="Description of Artificial Sequence: Synthetic oligonucleotide"
acaguccuuaauccagaaaca

SEQ ID NO: 4005 - RNA, 21 nt, Artificial Sequence
  source: /note="Description of Artificial Sequence: Synthetic oligonucleotide"
acaguccuuaauccagaaaca

SEQ ID NO: 4006 - RNA, 21 nt, Artificial Sequence
  source: /note="Description of Artificial Sequence: Synthetic oligonucleotide"
accaggaaagacugauacaga

SEQ ID NO: 4007 - RNA, 21 nt, Artificial Sequence
  source: /note="Description of Artificial Sequence: Synthetic oligonucleotide"
accaggaaagacugauacaga

SEQ ID NO: 4008 - RNA, 21 nt, Artificial Sequence
  source: /note="Description of Artificial Sequence: Synthetic oligonucleotide"
accaggaaagacugauacaga

SEQ ID NO: 4009 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accaugcagatuaugcggaua

SEQ ID NO: 4010 - RNA, 21 nt, Artificial Sequence
  source: /note="Description of Artificial Sequence: Synthetic oligonucleotide"
accaugcagauuaugcggaua

SEQ ID NO: 4011 - RNA, 21 nt, Artificial Sequence
  source: /note="Description of Artificial Sequence: Synthetic oligonucleotide"
accaugcagauuaugcggaua

SEQ ID NO: 4012 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaacagucctuaauccagaa

SEQ ID NO: 4013 - RNA, 21 nt, Artificial Sequence
  source: /note="Description of Artificial Sequence: Synthetic oligonucleotide"
agaacaguccuuaauccagaa

SEQ ID NO: 4014 - RNA, 21 nt, Artificial Sequence
  source: /note="Description of Artificial Sequence: Synthetic oligonucleotide"
agaacaguccuuaauccagaa

SEQ ID NO: 4015 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauguaucutuugcucucua

SEQ ID NO: 4016 - RNA, 21 nt, Artificial Sequence
  source: /note="Description of Artificial Sequence: Synthetic oligonucleotide"
agauguaucuuuugcucucua

SEQ ID NO: 4017 - RNA, 21 nt, Artificial Sequence
  source: /note="Description of Artificial Sequence: Synthetic oligonucleotide"
agauguaucuuuugcucucua

SEQ ID NO: 4018 - RNA, 21 nt, Artificial Sequence
  source: /note="Description of Artificial Sequence: Synthetic oligonucleotide"
agauuagagaguuuuauuuca

SEQ ID NO: 4019 - RNA, 21 nt, Artificial Sequence
  source: /note="Description of Artificial Sequence: Synthetic oligonucleotide"
agauuagagaguuuuauuuca

SEQ ID NO: 4020 - RNA, 21 nt, Artificial Sequence
  source: /note="Description of Artificial Sequence: Synthetic oligonucleotide"
agauuagagaguuuuauuuca

SEQ ID NO: 4021 - RNA, 21 nt, Artificial Sequence
  source: /note="Description of Artificial Sequence: Synthetic oligonucleotide"
auacagaacgaucgauacaga

SEQ ID NO: 4022 - RNA, 21 nt, Artificial Sequence
  source: /note="Description of Artificial Sequence: Synthetic oligonucleotide"
auacagaacgaucgauacaga

SEQ ID NO: 4023 - RNA, 21 nt, Artificial Sequence
  source: /note="Description of Artificial Sequence: Synthetic oligonucleotide"
auacagaacgaucgauacaga

SEQ ID NO: 4024 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augcagautatgcggaucaaa

SEQ ID NO: 4025 - RNA, 21 nt, Artificial Sequence
  source: /note="Description of Artificial Sequence: Synthetic oligonucleotide"
augcagauuaugcggaucaaa

SEQ ID NO: 4026 - RNA, 21 nt, Artificial Sequence
  source: /note="Description of Artificial Sequence: Synthetic oligonucleotide"
augcagauuaugcggaucaaa

SEQ ID NO: 4027 - RNA, 21 nt, Artificial Sequence
  source: /note="Description of Artificial Sequence: Synthetic oligonucleotide"
auuggauucgccauuuuauua

SEQ ID NO: 4028 - RNA, 21 nt, Artificial Sequence
  source: /note="Description of Artificial Sequence: Synthetic oligonucleotide"
auuggauucgccauuuuauua

SEQ ID NO: 4029 - RNA, 21 nt, Artificial Sequence
  source: /note="Description of Artificial Sequence: Synthetic oligonucleotide"
auuggauucgccauuuuauua

SEQ ID NO: 4030 - RNA, 21 nt, Artificial Sequence
  source: /note="Description of Artificial Sequence: Synthetic oligonucleotide"
caacaucaccaugcagauuaa

SEQ ID NO: 4031 - RNA, 21 nt, Artificial Sequence
  source: /note="Description of Artificial Sequence: Synthetic oligonucleotide"
caacaucaccaugcagauuaa

SEQ ID NO: 4032 - RNA, 21 nt, Artificial Sequence
  source: /note="Description of Artificial Sequence: Synthetic oligonucleotide"
caacaucaccaugcagauuaa

SEQ ID NO: 4033 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaacagtccuuaauccaga

SEQ ID NO: 4034 - RNA, 21 nt, Artificial Sequence
  source: /note="Description of Artificial Sequence: Synthetic oligonucleotide"
cagaacaguccuuaauccaga

SEQ ID NO: 4035 - RNA, 21 nt, Artificial Sequence
  source: /note="Description of Artificial Sequence: Synthetic oligonucleotide"
cagaacaguccuuaauccaga

SEQ ID NO: 4036 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucaccatgcagauuaugca

SEQ ID NO: 4037 - RNA, 21 nt, Artificial Sequence
  source: /note="Description of Artificial Sequence: Synthetic oligonucleotide"
caucaccaugcagauuaugca

SEQ ID NO: 4038 - RNA, 21 nt, Artificial Sequence
  source: /note="Description of Artificial Sequence: Synthetic oligonucleotide"
caucaccaugcagauuaugca

SEQ ID NO: 4039 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucuuggaatuggauucgca

SEQ ID NO: 4040 - RNA, 21 nt, Artificial Sequence
  source: /note="Description of Artificial Sequence: Synthetic oligonucleotide"
ccucuuggaauuggauucgca

SEQ ID NO: 4041 - RNA, 21 nt, Artificial Sequence
  source: /note="Description of Artificial Sequence: Synthetic oligonucleotide"
ccucuuggaauuggauucgca

SEQ ID NO: 4042 - RNA, 21 nt, Artificial Sequence
  source: /note="Description of Artificial Sequence: Synthetic oligonucleotide"
cuacagcacaacaaaugugaa

SEQ ID NO: 4043 - RNA, 21 nt, Artificial Sequence
  source: /note="Description of Artificial Sequence: Synthetic oligonucleotide"
cuacagcacaacaaaugugaa

SEQ ID NO: 4044 - RNA, 21 nt, Artificial Sequence
  source: /note="Description of Artificial Sequence: Synthetic oligonucleotide"
cuacagcacaacaaaugugaa

SEQ ID NO: 4045 - RNA, 21 nt, Artificial Sequence
  source: /note="Description of Artificial Sequence: Synthetic oligonucleotide"
cugauacagaacgaucgauaa

SEQ ID NO: 4046 - RNA, 21 nt, Artificial Sequence
  source: /note="Description of Artificial Sequence: Synthetic oligonucleotide"
cugauacagaacgaucgauaa

SEQ ID NO: 4047 - RNA, 21 nt, Artificial Sequence
  source: /note="Description of Artificial Sequence: Synthetic oligonucleotide"
cugauacagaacgaucgauaa

SEQ ID NO: 4048 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaagugututauauacggua

SEQ ID NO: 4049 - RNA, 21 nt, Artificial Sequence
  source: /note="Description of Artificial Sequence: Synthetic oligonucleotide"
gaaaguguuuuauauacggua

SEQ ID NO: 4050 - RNA, 21 nt, Artificial Sequence
  source: /note="Description of Artificial Sequence: Synthetic oligonucleotide"
gaaaguguuuuauauacggua

SEQ ID NO: 4051 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagaaagugutuuauauacga

SEQ ID NO: 4052 - RNA, 21 nt, Artificial Sequence
  source: /note="Description of Artificial Sequence: Synthetic oligonucleotide"
gagaaaguguuuuauauacga

SEQ ID NO: 4053 - RNA, 21 nt, Artificial Sequence
  source: /note="Description of Artificial Sequence: Synthetic oligonucleotide"
gagaaaguguuuuauauacga

SEQ ID NO: 4054 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauucgccautuuauuuuuca

SEQ ID NO: 4055 - RNA, 21 nt, Artificial Sequence
  source: /note="Description of Artificial Sequence: Synthetic oligonucleotide"
gauucgccauuuuauuuuuca

SEQ ID NO: 4056 - RNA, 21 nt, Artificial Sequence
  source: /note="Description of Artificial Sequence: Synthetic oligonucleotide"
gauucgccauuuuauuuuuca

SEQ ID NO: 4057 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guccuuaatccagaaaccuga

SEQ ID NO: 4058 - RNA, 21 nt, Artificial Sequence
  source: /note="Description of Artificial Sequence: Synthetic oligonucleotide"
guccuuaauccagaaaccuga

SEQ ID NO: 4059 - RNA, 21 nt, Artificial Sequence
  source: /note="Description of Artificial Sequence: Synthetic oligonucleotide"
guccuuaauccagaaaccuga

SEQ ID NO: 4060 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guguuuuatatacgguacuua

SEQ ID NO: 4061 - RNA, 21 nt, Artificial Sequence
  source: /note="Description of Artificial Sequence: Synthetic oligonucleotide"
guguuuuauauacgguacuua

SEQ ID NO: 4062 - RNA, 21 nt, Artificial Sequence
  source: /note="Description of Artificial Sequence: Synthetic oligonucleotide"
guguuuuauauacgguacuua

SEQ ID NO: 4063 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagacauugctauucuguuua

SEQ ID NO: 4064 - RNA, 21 nt, Artificial Sequence
  source: /note="Description of Artificial Sequence: Synthetic oligonucleotide"
uagacauugcuauucuguuua

SEQ ID NO: 4065 - RNA, 21 nt, Artificial Sequence
  source: /note="Description of Artificial Sequence: Synthetic oligonucleotide"
uagacauugcuauucuguuua

SEQ ID NO: 4066 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utauaaaacactutctcuuuucu

SEQ ID NO: 4067 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utauaaaacactuucucuuuucu

SEQ ID NO: 4068 - RNA, 23 nt, Artificial Sequence
  source: /note="Description of Artificial Sequence: Synthetic oligonucleotide"
uuauaaaacacuuucucuuuucu

SEQ ID NO: 4069 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucgutcuguaucagucuuucc

SEQ ID NO: 4070 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucgutcuguaucagucuuucc

SEQ ID NO: 4071 - RNA, 23 nt, Artificial Sequence
  source: /note="Description of Artificial Sequence: Synthetic oligonucleotide"
uaucguucuguaucagucuuucc

SEQ ID NO: 4072 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauataaaacacutucucuuuuc

SEQ ID NO: 4073 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauataaaacacuuucucuuuuc

SEQ ID NO: 4074 - RNA, 23 nt, Artificial Sequence
  source: /note="Description of Artificial Sequence: Synthetic oligonucleotide"
uauauaaaacacuuucucuuuuc

SEQ ID NO: 4075 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaauaacautagcacuguugg

SEQ ID NO: 4076 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaauaacautagcacuguugg

SEQ ID NO: 4077 - RNA, 23 nt, Artificial Sequence
  source: /note="Description of Artificial Sequence: Synthetic oligonucleotide"
uccaauaacauuagcacuguugg

SEQ ID NO: 4078 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggtuucuguaucgaucguucu

SEQ ID NO: 4079 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggtuucuguaucgaucguucu

SEQ ID NO: 4080 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuggtuucuguaucgaucguucu

SEQ ID NO: 4081 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaucguucugtatcagucuuuc

SEQ ID NO: 4082 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaucguucugtaucagucuuuc

SEQ ID NO: 4083 - RNA, 23 nt, Artificial Sequence
  source: /note="Description of Artificial Sequence: Synthetic oligonucleotide"
ugaucguucuguaucagucuuuc

SEQ ID NO: 4084 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utauauaaaacactutcucuuuu

SEQ ID NO: 4085 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utauauaaaacacuuucucuuuu

SEQ ID NO: 4086 - RNA, 23 nt, Artificial Sequence
  source: /note="Description of Artificial Sequence: Synthetic oligonucleotide"
uuauauaaaacacuuucucuuuu

SEQ ID NO: 4087 - RNA, 23 nt, Artificial Sequence
  source: /note="Description of Artificial Sequence: Synthetic oligonucleotide"
uauaaaauggcgaauccaauucc

SEQ ID NO: 4088 - RNA, 23 nt, Artificial Sequence
  source: /note="Description of Artificial Sequence: Synthetic oligonucleotide"
uauaaaauggcgaauccaauucc

SEQ ID NO: 4089 - RNA, 23 nt, Artificial Sequence
  source: /note="Description of Artificial Sequence: Synthetic oligonucleotide"
uauaaaauggcgaauccaauucc

SEQ ID NO: 4090 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggautaaggactgtucugucg

SEQ ID NO: 4091 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utggautaaggacuguucugucg

SEQ ID NO: 4092 - RNA, 23 nt, Artificial Sequence
  source: /note="Description of Artificial Sequence: Synthetic oligonucleotide"
uuggauuaaggacuguucugucg

SEQ ID NO: 4093 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguutcuggautaaggacuguuc

SEQ ID NO: 4094 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguutcuggautaaggacuguuc

SEQ ID NO: 4095 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguutcuggauuaaggacuguuc

SEQ ID NO: 4096 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtatcagucutuccuggugc

SEQ ID NO: 4097 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtatcagucuuuccuggugc

SEQ ID NO: 4098 - RNA, 23 nt, Artificial Sequence
  source: /note="Description of Artificial Sequence: Synthetic oligonucleotide"
ucuguaucagucuuuccuggugc

SEQ ID NO: 4099 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauccgcauaatctgcauggugc

SEQ ID NO: 4100 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauccgcauaatcugcauggugc

SEQ ID NO: 4101 - RNA, 23 nt, Artificial Sequence
  source: /note="Description of Artificial Sequence: Synthetic oligonucleotide"
uauccgcauaaucugcauggugc

SEQ ID NO: 4102 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcuggauuaaggactguucugu

SEQ ID NO: 4103 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcuggauuaaggacuguucugu

SEQ ID NO: 4104 - RNA, 23 nt, Artificial Sequence
  source: /note="Description of Artificial Sequence: Synthetic oligonucleotide"
uucuggauuaaggacuguucugu

SEQ ID NO: 4105 - RNA, 23 nt, Artificial Sequence
  source: /note="Description of Artificial Sequence: Synthetic oligonucleotide"
uagagagcaaaagauacaucucg

SEQ ID NO: 4106 - RNA, 23 nt, Artificial Sequence
  source: /note="Description of Artificial Sequence: Synthetic oligonucleotide"
uagagagcaaaagauacaucucg

SEQ ID NO: 4107 - RNA, 23 nt, Artificial Sequence
  source: /note="Description of Artificial Sequence: Synthetic oligonucleotide"
uagagagcaaaagauacaucucg

SEQ ID NO: 4108 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaauaaaactctctaaucuuc

SEQ ID NO: 4109 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaauaaaactcucuaaucuuc

SEQ ID NO: 4110 - RNA, 23 nt, Artificial Sequence
  source: /note="Description of Artificial Sequence: Synthetic oligonucleotide"
ugaaauaaaacucucuaaucuuc

SEQ ID NO: 4111 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtaucgaucgtucuguaucg

SEQ ID NO: 4112 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtaucgaucguucuguaucg

SEQ ID NO: 4113 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtaucgaucguucuguaucg

SEQ ID NO: 4114 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugauccgcataaucugcaugg

SEQ ID NO: 4115 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugauccgcataaucugcaugg

SEQ ID NO: 4116 - RNA, 23 nt, Artificial Sequence
  source: /note="Description of Artificial Sequence: Synthetic oligonucleotide"
uuugauccgcauaaucugcaugg

SEQ ID NO: 4117 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaauaaaauggcgaatccaauuc

SEQ ID NO: 4118 - RNA, 23 nt, Artificial Sequence
  source: /note="Description of Artificial Sequence: Synthetic oligonucleotide"
uaauaaaauggcgaauccaauuc

SEQ ID NO: 4119 - RNA, 23 nt, Artificial Sequence
  source: /note="Description of Artificial Sequence: Synthetic oligonucleotide"
uaauaaaauggcgaauccaauuc

SEQ ID NO: 4120 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaatcugcauggtgauguuggc

SEQ ID NO: 4121 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaatcugcauggugauguuggc

SEQ ID NO: 4122 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaatcugcauggugauguuggc

SEQ ID NO: 4123 - RNA, 23 nt, Artificial Sequence
  source: /note="Description of Artificial Sequence: Synthetic oligonucleotide"
ucuggauuaaggacuguucuguc

SEQ ID NO: 4124 - RNA, 23 nt, Artificial Sequence
  source: /note="Description of Artificial Sequence: Synthetic oligonucleotide"
ucuggauuaaggacuguucuguc

SEQ ID NO: 4125 - RNA, 23 nt, Artificial Sequence
  source: /note="Description of Artificial Sequence: Synthetic oligonucleotide"
ucuggauuaaggacuguucuguc

SEQ ID NO: 4126 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcataaucugcatggugauguu

SEQ ID NO: 4127 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcataaucugcauggugauguu

SEQ ID NO: 4128 - RNA, 23 nt, Artificial Sequence
  source: /note="Description of Artificial Sequence: Synthetic oligonucleotide"
ugcauaaucugcauggugauguu

SEQ ID NO: 4129 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcgaatccaatuccaagagggc

SEQ ID NO: 4130 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcgaatccaatuccaagagggc

SEQ ID NO: 4131 - RNA, 23 nt, Artificial Sequence
  source: /note="Description of Artificial Sequence: Synthetic oligonucleotide"
ugcgaauccaauuccaagagggc

SEQ ID NO: 4132 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcacatuugutgtgcuguaggg

SEQ ID NO: 4133 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcacatuugutgugcuguaggg

SEQ ID NO: 4134 - RNA, 23 nt, Artificial Sequence
  source: /note="Description of Artificial Sequence: Synthetic oligonucleotide"
uucacauuuguugugcuguaggg

SEQ ID NO: 4135 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaucgaucgutctgtaucaguc

SEQ ID NO: 4136 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaucgaucgutcuguaucaguc

SEQ ID NO: 4137 - RNA, 23 nt, Artificial Sequence
  source: /note="Description of Artificial Sequence: Synthetic oligonucleotide"
uuaucgaucguucuguaucaguc

SEQ ID NO: 4138 - RNA, 23 nt, Artificial Sequence
  source: /note="Description of Artificial Sequence: Synthetic oligonucleotide"
uaccguauauaaaacacuuucuc

SEQ ID NO: 4139 - RNA, 23 nt, Artificial Sequence
  source: /note="Description of Artificial Sequence: Synthetic oligonucleotide"
uaccguauauaaaacacuuucuc

SEQ ID NO: 4140 - RNA, 23 nt, Artificial Sequence
  source: /note="Description of Artificial Sequence: Synthetic oligonucleotide"
uaccguauauaaaacacuuucuc

SEQ ID NO: 4141 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucguauauaaaacactuucucuu

SEQ ID NO: 4142 - RNA, 23 nt, Artificial Sequence
  source: /note="Description of Artificial Sequence: Synthetic oligonucleotide"
ucguauauaaaacacuuucucuu

SEQ ID NO: 4143 - RNA, 23 nt, Artificial Sequence
  source: /note="Description of Artificial Sequence: Synthetic oligonucleotide"
ucguauauaaaacacuuucucuu

SEQ ID NO: 4144 - RNA, 23 nt, Artificial Sequence
  source: /note="Description of Artificial Sequence: Synthetic oligonucleotide"
ugaaaaauaaaauggcgaauccg

SEQ ID NO: 4145 - RNA, 23 nt, Artificial Sequence
  source: /note="Description of Artificial Sequence: Synthetic oligonucleotide"
ugaaaaauaaaauggcgaauccg

SEQ ID NO: 4146 - RNA, 23 nt, Artificial Sequence
  source: /note="Description of Artificial Sequence: Synthetic oligonucleotide"
ugaaaaauaaaauggcgaauccg

SEQ ID NO: 4147 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaggutucuggatuaaggacug

SEQ ID NO: 4148 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaggutucuggauuaaggacug

SEQ ID NO: 4149 - RNA, 23 nt, Artificial Sequence
  source: /note="Description of Artificial Sequence: Synthetic oligonucleotide"
ucagguuucuggauuaaggacug

SEQ ID NO: 4150 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagtaccguatataaaacacuu

SEQ ID NO: 4151 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagtaccguatauaaaacacuu

SEQ ID NO: 4152 - RNA, 23 nt, Artificial Sequence
  source: /note="Description of Artificial Sequence: Synthetic oligonucleotide"
uaaguaccguauauaaaacacuu

SEQ ID NO: 4153 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaacagaauagcaatgucuauu

SEQ ID NO: 4154 - RNA, 23 nt, Artificial Sequence
  source: /note="Description of Artificial Sequence: Synthetic oligonucleotide"
uaaacagaauagcaaugucuauu

SEQ ID NO: 4155 - RNA, 23 nt, Artificial Sequence
  source: /note="Description of Artificial Sequence: Synthetic oligonucleotide"
uaaacagaauagcaaugucuauu

SEQ ID NO: 4156 - RNA, 21 nt, Artificial Sequence
  source: /note="Description of Artificial Sequence: Synthetic oligonucleotide"
aagacugauacagaacgauca

SEQ ID NO: 4157 - RNA, 21 nt, Artificial Sequence
  source: /note="Description of Artificial Sequence: Synthetic oligonucleotide"
acgguacuuauuuaauaucca

SEQ ID NO: 4158 - protein, 16 aa, Unknown
  source: /note="Description of Unknown: RFGF peptide"
AAVALLPAVLLALLAP

SEQ ID NO: 4159 - protein, 11 aa, Unknown
  source: /note="Description of Unknown: RFGF analogue peptide"
AALLPVLLAAP

SEQ ID NO: 4160 - protein, 13 aa, Human immunodeficiency virus
GRKKRRQRRRPPQ

SEQ ID NO: 4161 - protein, 16 aa, Drosophila sp.
RQIKIWFQNRRMKWKK

SEQ ID NO: 4162 - RNA, 21 nt, Artificial Sequence
  source: /note="Description of Artificial Sequence: Synthetic oligonucleotide"
aacaguguucuugcucuauaa

SEQ ID NO: 4163 - RNA, 23 nt, Artificial Sequence
  source: /note="Description of Artificial Sequence: Synthetic oligonucleotide"
uuauagagcaagaacacuguuuu

SEQ ID NO: 4164 - RNA, 21 nt, Artificial Sequence
  source: /note="Description of Artificial Sequence: Synthetic oligonucleotide"
cgacagaacaguccuuaauca

SEQ ID NO: 4165 - RNA, 21 nt, Artificial Sequence
  source: /note="Description of Artificial Sequence: Synthetic oligonucleotide"
cagaacaguccuuaauccaga

SEQ ID NO: 4166 - RNA, 21 nt, Artificial Sequence
  source: /note="Description of Artificial Sequence: Synthetic oligonucleotide"
cagaacaguccuuaauccaga

SEQ ID NO: 4167 - RNA, 21 nt, Artificial Sequence
  source: /note="Description of Artificial Sequence: Synthetic oligonucleotide"
aacagugcuaauguuauugga

SEQ ID NO: 4168 - RNA, 21 nt, Artificial Sequence
  source: /note="Description of Artificial Sequence: Synthetic oligonucleotide"
agugcuaauguuauuggugua

SEQ ID NO: 4169 - RNA, 21 nt, Artificial Sequence
  source: /note="Description of Artificial Sequence: Synthetic oligonucleotide"
gagaaaguguuuuauauacga

SEQ ID NO: 4170 - RNA, 21 nt, Artificial Sequence
  source: /note="Description of Artificial Sequence: Synthetic oligonucleotide"
aaaauagacauugcuauucua

SEQ ID NO: 4171 - RNA, 21 nt, Artificial Sequence
  source: /note="Description of Artificial Sequence: Synthetic oligonucleotide"
aaauagacauugcuauucuga

SEQ ID NO: 4172 - RNA, 21 nt, Artificial Sequence
  source: /note="Description of Artificial Sequence: Synthetic oligonucleotide"
gaaaguguuuuauauacggua

SEQ ID NO: 4173 - RNA, 21 nt, Artificial Sequence
  source: /note="Description of Artificial Sequence: Synthetic oligonucleotide"
guuuuauauacgguacuuaua

SEQ ID NO: 4174 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugcuaatgtuauuggugua

SEQ ID NO: 4175 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaauagacatugcuauucua

SEQ ID NO: 4176 - RNA, 23 nt, Artificial Sequence
  source: /note="Description of Artificial Sequence: Synthetic oligonucleotide"
ugauuaaggacuguucugucgau

SEQ ID NO: 4177 - RNA, 23 nt, Artificial Sequence
  source: /note="Description of Artificial Sequence: Synthetic oligonucleotide"
ucuggauuaaggacuguucuguc

SEQ ID NO: 4178 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuggatuaaggacuguucuguc

SEQ ID NO: 4179 - RNA, 23 nt, Artificial Sequence
  source: /note="Description of Artificial Sequence: Synthetic oligonucleotide"
uccaauaacauuagcacuguuaa

SEQ ID NO: 4180 - RNA, 23 nt, Artificial Sequence
  source: /note="Description of Artificial Sequence: Synthetic oligonucleotide"
uacaccaauaacauuagcacugu

SEQ ID NO: 4181 - RNA, 23 nt, Artificial Sequence
  source: /note="Description of Artificial Sequence: Synthetic oligonucleotide"
ucguauauaaaacacuuucucuu

SEQ ID NO: 4182 - RNA, 23 nt, Artificial Sequence
  source: /note="Description of Artificial Sequence: Synthetic oligonucleotide"
uagaauagcaaugucuauuuuau

SEQ ID NO: 4183 - RNA, 23 nt, Artificial Sequence
  source: /note="Description of Artificial Sequence: Synthetic oligonucleotide"
ucagaauagcaaugucuauuuua

SEQ ID NO: 4184 - RNA, 23 nt, Artificial Sequence
  source: /note="Description of Artificial Sequence: Synthetic oligonucleotide"
uaccguauauaaaacacuuucuc

SEQ ID NO: 4185 - RNA, 23 nt, Artificial Sequence
  source: /note="Description of Artificial Sequence: Synthetic oligonucleotide"
uauaaguaccguauauaaaacac

SEQ ID NO: 4186 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacaccaauaacatuagcacugu

SEQ ID NO: 4187 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagaauagcaatgtctauuuuau

SEQ ID NO: 4188 - RNA, 23 nt, Homo sapiens
aucgacagaacaguccuuaaucc

SEQ ID NO: 4189 - RNA, 23 nt, Homo sapiens
gacagaacaguccuuaauccaga

SEQ ID NO: 4190 - RNA, 23 nt, Homo sapiens
gacagaacaguccuuaauccaga

SEQ ID NO: 4191 - RNA, 23 nt, Homo sapiens
uuaacagugcuaauguuauuggu

SEQ ID NO: 4192 - RNA, 23 nt, Homo sapiens
acagugcuaauguuauugguguc

SEQ ID NO: 4193 - RNA, 23 nt, Homo sapiens
aagagaaaguguuuuauauacgg

SEQ ID NO: 4194 - RNA, 23 nt, Homo sapiens
auaaaauagacauugcuauucug

SEQ ID NO: 4195 - RNA, 23 nt, Homo sapiens
uaaaauagacauugcuauucugu

SEQ ID NO: 4196 - RNA, 23 nt, Homo sapiens
gagaaaguguuuuauauacggua

SEQ ID NO: 4197 - RNA, 23 nt, Homo sapiens
guguuuuauauacgguacuuauu

SEQ ID NO: 4198 - RNA, 23 nt, Homo sapiens
acagugcuaauguuauugguguc

SEQ ID NO: 4199 - RNA, 23 nt, Homo sapiens
auaaaauagacauugcuauucug

SEQ ID NO: 4200 - RNA, 21 nt, Artificial Sequence
  source: /note="Description of Artificial Sequence: Synthetic oligonucleotide"
cgacagaacaguccuuaauca

SEQ ID NO: 4201 - RNA, 21 nt, Artificial Sequence
  source: /note="Description of Artificial Sequence: Synthetic oligonucleotide"
cagaacaguccuuaauccaga

SEQ ID NO: 4202 - RNA, 21 nt, Artificial Sequence
  source: /note="Description of Artificial Sequence: Synthetic oligonucleotide"
cagaacaguccuuaauccaga

SEQ ID NO: 4203 - RNA, 21 nt, Artificial Sequence
  source: /note="Description of Artificial Sequence: Synthetic oligonucleotide"
aacagugcuaauguuauugga

SEQ ID NO: 4204 - RNA, 21 nt, Artificial Sequence
  source: /note="Description of Artificial Sequence: Synthetic oligonucleotide"
agugcuaauguuauuggugua

SEQ ID NO: 4205 - RNA, 21 nt, Artificial Sequence
  source: /note="Description of Artificial Sequence: Synthetic oligonucleotide"
gagaaaguguuuuauauacga

SEQ ID NO: 4206 - RNA, 21 nt, Artificial Sequence
  source: /note="Description of Artificial Sequence: Synthetic oligonucleotide"
aaaauagacauugcuauucua

SEQ ID NO: 4207 - RNA, 21 nt, Artificial Sequence
  source: /note="Description of Artificial Sequence: Synthetic oligonucleotide"
aaauagacauugcuauucuga

SEQ ID NO: 4208 - RNA, 21 nt, Artificial Sequence
  source: /note="Description of Artificial Sequence: Synthetic oligonucleotide"
gaaaguguuuuauauacggua

SEQ ID NO: 4209 - RNA, 21 nt, Artificial Sequence
  source: /note="Description of Artificial Sequence: Synthetic oligonucleotide"
guuuuauauacgguacuuaua

SEQ ID NO: 4210 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugcuaatgtuauuggugua

SEQ ID NO: 4211 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaauagacatugcuauucua

SEQ ID NO: 4212 - RNA, 23 nt, Artificial Sequence
  source: /note="Description of Artificial Sequence: Synthetic oligonucleotide"
ugauuaaggacuguucugucgau

SEQ ID NO: 4213 - RNA, 23 nt, Artificial Sequence
  source: /note="Description of Artificial Sequence: Synthetic oligonucleotide"
ucuggauuaaggacuguucuguc

SEQ ID NO: 4214 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuggatuaaggacuguucuguc

SEQ ID NO: 4215 - RNA, 23 nt, Artificial Sequence
  source: /note="Description of Artificial Sequence: Synthetic oligonucleotide"
uccaauaacauuagcacuguuaa

SEQ ID NO: 4216 - RNA, 23 nt, Artificial Sequence
  source: /note="Description of Artificial Sequence: Synthetic oligonucleotide"
uacaccaauaacauuagcacugu

SEQ ID NO: 4217 - RNA, 23 nt, Artificial Sequence
  source: /note="Description of Artificial Sequence: Synthetic oligonucleotide"
ucguauauaaaacacuuucucuu

SEQ ID NO: 4218 - RNA, 23 nt, Artificial Sequence
  source: /note="Description of Artificial Sequence: Synthetic oligonucleotide"
uagaauagcaaugucuauuuuau

SEQ ID NO: 4219 - RNA, 23 nt, Artificial Sequence
  source: /note="Description of Artificial Sequence: Synthetic oligonucleotide"
ucagaauagcaaugucuauuuua

SEQ ID NO: 4220 - RNA, 23 nt, Artificial Sequence
  source: /note="Description of Artificial Sequence: Synthetic oligonucleotide"
uaccguauauaaaacacuuucuc

SEQ ID NO: 4221 - RNA, 23 nt, Artificial Sequence
  source: /note="Description of Artificial Sequence: Synthetic oligonucleotide"
uauaaguaccguauauaaaacac

SEQ ID NO: 4222 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacaccaauaacatuagcacugu

SEQ ID NO: 4223 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagaauagcaatgtctauuuuau

SEQ ID NO: 4224 - RNA, 23 nt, Homo sapiens
gaaagacugauacagaacgaucg

SEQ ID NO: 4225 - RNA, 23 nt, Homo sapiens
auacgguacuuauuuaauauccc

SEQ ID NO: 4226 - RNA, 23 nt, Homo sapiens
gacagaacaguccuuaauccaga

SEQ ID NO: 4227 - RNA, 23 nt, Homo sapiens
aucgacagaacaguccuuaaucc

SEQ ID NO: 4228 - RNA, 23 nt, Homo sapiens
aagcauuuguuuguacaagaucc

SEQ ID NO: 4229 - RNA, 23 nt, Homo sapiens
guuauuggugucuucacuggaug

SEQ ID NO: 4230 - RNA, 23 nt, Homo sapiens
agacugauacagaacgaucgaua

SEQ ID NO: 4231 - RNA, 23 nt, Homo sapiens
ggaaagacugauacagaacgauc

SEQ ID NO: 4232 - RNA, 23 nt, Homo sapiens
ugauacagaacgaucgauacaga

SEQ ID NO: 4233 - RNA, 23 nt, Homo sapiens
gacugauacagaacgaucgauac

SEQ ID NO: 4234 - RNA, 23 nt, Homo sapiens
aagagaaaguguuuuauauacgg

SEQ ID NO: 4235 - RNA, 23 nt, Homo sapiens
aaacgaacguacuugcagaugug

SEQ ID NO: 4236 - RNA, 23 nt, Homo sapiens
cucuuggaauuggauucgccauu

SEQ ID NO: 4237 - RNA, 23 nt, Homo sapiens
gaggcagcuugaguuaaacgaac

SEQ ID NO: 4238 - RNA, 23 nt, Homo sapiens
gagggcagaaucaucacgaagug

SEQ ID NO: 4239 - RNA, 23 nt, Homo sapiens
aguuaaacgaacguacuugcaga

SEQ ID NO: 4240 - RNA, 23 nt, Homo sapiens
auguuauuggugucuucacugga

SEQ ID NO: 4241 - RNA, 23 nt, Homo sapiens
gcagcuugaguuaaacgaacgua

SEQ ID NO: 4242 - RNA, 23 nt, Homo sapiens
aggcagcuugaguuaaacgaacg

SEQ ID NO: 4243 - RNA, 23 nt, Homo sapiens
cacgaaguggugaaguucaugga

SEQ ID NO: 4244 - RNA, 23 nt, Homo sapiens
ggcagaaucaucacgaaguggug

SEQ ID NO: 4245 - RNA, 23 nt, Homo sapiens
auaaaauagacauugcuauucug

SEQ ID NO: 4246 - RNA, 23 nt, Homo sapiens
ggcagcuugaguuaaacgaacgu

SEQ ID NO: 4247 - RNA, 23 nt, Homo sapiens
gucgcacugaaacuuuucgucca

SEQ ID NO: 4248 - RNA, 23 nt, Homo sapiens
gcagauuaugcggaucaaaccuc

SEQ ID NO: 4249 - RNA, 23 nt, Homo sapiens
uugcucucuuauuuguaccgguu

SEQ ID NO: 4250 - RNA, 23 nt, Homo sapiens
ggugacagucacuagcuuaucuu

SEQ ID NO: 4251 - RNA, 23 nt, Homo sapiens
agcuugaguuaaacgaacguacu

SEQ ID NO: 4252 - RNA, 23 nt, Homo sapiens
acagugcuaauguuauugguguc

SEQ ID NO: 4253 - RNA, 23 nt, Homo sapiens
agauccgcagacguguaaauguu

SEQ ID NO: 4254 - RNA, 23 nt, Homo sapiens
aaagacugauacagaacgaucga

SEQ ID NO: 4255 - RNA, 23 nt, Homo sapiens
aauguuauuggugucuucacugg

SEQ ID NO: 4256 - RNA, 23 nt, Homo sapiens
cggugcuggaauuugauauucau

SEQ ID NO: 4257 - RNA, 23 nt, Homo sapiens
ucuugcugcuaaaucaccgagcc

SEQ ID NO: 4258 - RNA, 23 nt, Homo sapiens
aucaccaugcagauuaugcggau

SEQ ID NO: 4259 - RNA, 23 nt, Homo sapiens
gagaaagcauuuguuuguacaag

SEQ ID NO: 4260 - RNA, 23 nt, Homo sapiens
cagcuugaguuaaacgaacguac

SEQ ID NO: 4261 - RNA, 23 nt, Homo sapiens
gaucggugacagucacuagcuua

SEQ ID NO: 4262 - RNA, 23 nt, Homo sapiens
cgaggcagcuugaguuaaacgaa

SEQ ID NO: 4263 - RNA, 23 nt, Homo sapiens
uccugcaaaaacacagacucgcg

SEQ ID NO: 4264 - RNA, 23 nt, Homo sapiens
uucuugcugcuaaaucaccgagc

SEQ ID NO: 4265 - RNA, 23 nt, Homo sapiens
uuuucuugcugcuaaaucaccga

SEQ ID NO: 4266 - RNA, 23 nt, Homo sapiens
agaaagcauuuguuuguacaaga

SEQ ID NO: 4267 - RNA, 23 nt, Homo sapiens
gauccgcagacguguaaauguuc

SEQ ID NO: 4268 - RNA, 23 nt, Homo sapiens
uacgguacuuauuuaauaucccu

SEQ ID NO: 4269 - RNA, 23 nt, Homo sapiens
aagacugauacagaacgaucgau

SEQ ID NO: 4270 - RNA, 23 nt, Homo sapiens
caaaaacacagacucgcguugca

SEQ ID NO: 4271 - RNA, 23 nt, Homo sapiens
uugaguuaaacgaacguacuugc

SEQ ID NO: 4272 - RNA, 23 nt, Homo sapiens
cuucacuggauguauuugacugc

SEQ ID NO: 4273 - RNA, 23 nt, Homo sapiens
ggccuccgaaaccaugaacuuuc

SEQ ID NO: 4274 - RNA, 23 nt, Homo sapiens
gcuugaguuaaacgaacguacuu

SEQ ID NO: 4275 - RNA, 23 nt, Homo sapiens
ggugcuacuguuuauccguaaua

SEQ ID NO: 4276 - RNA, 23 nt, Homo sapiens
auccgcagacguguaaauguucc

SEQ ID NO: 4277 - RNA, 23 nt, Homo sapiens
uccgcagacguguaaauguuccu

SEQ ID NO: 4278 - RNA, 23 nt, Homo sapiens
gaagagaagagacacauuguugg

SEQ ID NO: 4279 - RNA, 23 nt, Homo sapiens
cuacagcacaacaaaugugaaug

SEQ ID NO: 4280 - RNA, 23 nt, Homo sapiens
uuucuugcugcuaaaucaccgag

SEQ ID NO: 4281 - RNA, 23 nt, Homo sapiens
ucacaccauugaaaccacuaguu

SEQ ID NO: 4282 - RNA, 23 nt, Homo sapiens
gcgaggcagcuugaguuaaacga

SEQ ID NO: 4283 - RNA, 23 nt, Homo sapiens
ucgcacugaaacuuuucguccaa

SEQ ID NO: 4284 - RNA, 23 nt, Homo sapiens
guguuuuauauacgguacuuauu

SEQ ID NO: 4285 - RNA, 23 nt, Homo sapiens
cacaccauugaaaccacuaguuc

SEQ ID NO: 4286 - RNA, 23 nt, Homo sapiens
acaucaccaugcagauuaugcgg

SEQ ID NO: 4287 - RNA, 23 nt, Homo sapiens
cuugaguuaaacgaacguacuug

SEQ ID NO: 4288 - RNA, 23 nt, Homo sapiens
gagaaaguguuuuauauacggua

SEQ ID NO: 4289 - RNA, 23 nt, Homo sapiens
ugacagucacuagcuuaucuuga

SEQ ID NO: 4290 - RNA, 23 nt, Homo sapiens
uggugcuacuguuuauccguaau

SEQ ID NO: 4291 - RNA, 23 nt, Homo sapiens
uuccugcaaaaacacagacucgc

SEQ ID NO: 4292 - RNA, 23 nt, Homo sapiens
ugcaaaaacacagacucgcguug

SEQ ID NO: 4293 - RNA, 23 nt, Homo sapiens
acugcuguggacuugaguuggga

SEQ ID NO: 4294 - RNA, 23 nt, Homo sapiens
cagugcuaauguuauuggugucu

SEQ ID NO: 4295 - RNA, 23 nt, Homo sapiens
auuggugcuacuguuuauccgua

SEQ ID NO: 4296 - RNA, 23 nt, Homo sapiens
agagaaaguguuuuauauacggu

SEQ ID NO: 4297 - RNA, 23 nt, Homo sapiens
ucaacuauuuaugagauguaucu

SEQ ID NO: 4298 - RNA, 23 nt, Homo sapiens
ugaguuaaacgaacguacuugca

SEQ ID NO: 4299 - RNA, 23 nt, Homo sapiens
uacaucuucaagccauccugugu

SEQ ID NO: 4300 - RNA, 23 nt, Homo sapiens
gguuuuuuuucaguauucuuggu

SEQ ID NO: 4301 - RNA, 23 nt, Homo sapiens
guuuauccguaauaauugugggg

SEQ ID NO: 4302 - RNA, 23 nt, Homo sapiens
acgguacuuauuuaauaucccuu

SEQ ID NO: 4303 - RNA, 23 nt, Homo sapiens
aucacgucuuugucucuagugca

SEQ ID NO: 4304 - RNA, 23 nt, Homo sapiens
ccugcaaaaacacagacucgcgu

SEQ ID NO: 4305 - RNA, 23 nt, Homo sapiens
caacuauuuaugagauguaucuu

SEQ ID NO: 4306 - RNA, 23 nt, Homo sapiens
aaaggggcaaaaacgaaagcgca

SEQ ID NO: 4307 - RNA, 23 nt, Homo sapiens
ucuugcucucuuauuuguaccgg

SEQ ID NO: 4308 - RNA, 23 nt, Homo sapiens
gcauuuguuuguacaagauccgc

SEQ ID NO: 4309 - RNA, 23 nt, Homo sapiens
acuugcagaugugacaagccgag

SEQ ID NO: 4310 - RNA, 23 nt, Homo sapiens
uucaacuauuuaugagauguauc

SEQ ID NO: 4311 - RNA, 23 nt, Homo sapiens
agaauucuacauacuaaaucucu

SEQ ID NO: 4312 - RNA, 23 nt, Homo sapiens
cuauguccucacaccauugaaac

SEQ ID NO: 4313 - RNA, 23 nt, Homo sapiens
auuuguuuguacaagauccgcag

SEQ ID NO: 4314 - RNA, 23 nt, Homo sapiens
cuuaauccagaaaccugaaauga

SEQ ID NO: 4315 - RNA, 23 nt, Homo sapiens
aagaaaaaaaaucaguucgagga

SEQ ID NO: 4316 - RNA, 23 nt, Homo sapiens
aggggcaaaaacgaaagcgcaag

SEQ ID NO: 4317 - RNA, 23 nt, Homo sapiens
ggugaaguucauggaugucuauc

SEQ ID NO: 4318 - RNA, 23 nt, Homo sapiens
aucacgaaguggugaaguucaug

SEQ ID NO: 4319 - RNA, 23 nt, Homo sapiens
ucacgucuuugucucuagugcag

SEQ ID NO: 4320 - RNA, 23 nt, Homo sapiens
ccaacaucaccaugcagauuaug

SEQ ID NO: 4321 - RNA, 23 nt, Homo sapiens
uuggugcuacuguuuauccguaa

SEQ ID NO: 4322 - RNA, 23 nt, Homo sapiens
uaaaauagacauugcuauucugu

SEQ ID NO: 4323 - RNA, 23 nt, Homo sapiens
acuuccccaaaucacuguggauu

SEQ ID NO: 4324 - RNA, 23 nt, Homo sapiens
aagauccgcagacguguaaaugu

SEQ ID NO: 4325 - RNA, 23 nt, Homo sapiens
uauuaacaucacgucuuugucuc

SEQ ID NO: 4326 - RNA, 23 nt, Homo sapiens
gcaaagugagugaccugcuuuug

SEQ ID NO: 4327 - RNA, 23 nt, Homo sapiens
gcaaaaacacagacucgcguugc

SEQ ID NO: 4328 - RNA, 23 nt, Homo sapiens
ggcgucgcacugaaacuuuucgu

SEQ ID NO: 4329 - RNA, 23 nt, Homo sapiens
uuaacagugcuaauguuauuggu

SEQ ID NO: 4330 - RNA, 23 nt, Homo sapiens
uuuucguccaacuucugggcugu

SEQ ID NO: 4331 - RNA, 23 nt, Homo sapiens
uuauuggugucuucacuggaugu

SEQ ID NO: 4332 - RNA, 23 nt, Homo sapiens
cugcaaaaacacagacucgcguu

SEQ ID NO: 4333 - RNA, 23 nt, Homo sapiens
aaaaaaaucaguucgaggaaagg

SEQ ID NO: 4334 - RNA, 23 nt, Homo sapiens
cgcagacguguaaauguuccugc

SEQ ID NO: 4335 - RNA, 23 nt, Homo sapiens
uauguccucacaccauugaaacc

SEQ ID NO: 4336 - RNA, 23 nt, Homo sapiens
guuuuuuuucaguauucuugguu

SEQ ID NO: 4337 - RNA, 23 nt, Homo sapiens
caagauccgcagacguguaaaug

SEQ ID NO: 4338 - RNA, 23 nt, Homo sapiens
gucccucuuggaauuggauucgc

SEQ ID NO: 4339 - RNA, 23 nt, Homo sapiens
aagauauuaacaucacgucuuug

SEQ ID NO: 4340 - RNA, 23 nt, Homo sapiens
uauuggugcuacuguuuauccgu

SEQ ID NO: 4341 - RNA, 23 nt, Homo sapiens
gaaaggggcaaaaacgaaagcgc

SEQ ID NO: 4342 - RNA, 23 nt, Homo sapiens
uacuugcagaugugacaagccga

SEQ ID NO: 4343 - RNA, 23 nt, Homo sapiens
aaaaaucaguucgaggaaaggga

SEQ ID NO: 4344 - RNA, 23 nt, Homo sapiens
aaacuuuucguccaacuucuggg

SEQ ID NO: 4345 - RNA, 23 nt, Homo sapiens
auauuaacaucacgucuuugucu

SEQ ID NO: 4346 - RNA, 23 nt, Homo sapiens
cacgucuuugucucuagugcagu

SEQ ID NO: 4347 - RNA, 23 nt, Homo sapiens
aaaacacagacucgcguugcaag

SEQ ID NO: 4348 - RNA, 23 nt, Homo sapiens
agauauuaacaucacgucuuugu

SEQ ID NO: 4349 - RNA, 23 nt, Homo sapiens
cuguuuauccguaauaauugugg

SEQ ID NO: 4350 - RNA, 23 nt, Homo sapiens
aaaaaaucaguucgaggaaaggg

SEQ ID NO: 4351 - RNA, 23 nt, Homo sapiens
uguuuauccguaauaauuguggg

SEQ ID NO: 4352 - RNA, 23 nt, Homo sapiens
ucaggacauugcugugcuuuggg

SEQ ID NO: 4353 - RNA, 23 nt, Homo sapiens
agacugauacagaacgaucgaua

SEQ ID NO: 4354 - RNA, 23 nt, Homo sapiens
ggaaagacugauacagaacgauc

SEQ ID NO: 4355 - RNA, 23 nt, Homo sapiens
aagagaaaguguuuuauauacgg

SEQ ID NO: 4356 - RNA, 23 nt, Homo sapiens
aaagacugauacagaacgaucga

SEQ ID NO: 4357 - RNA, 23 nt, Homo sapiens
uucaacuauuuaugagauguauc

SEQ ID NO: 4358 - RNA, 23 nt, Homo sapiens
gaaagacugauacagaacgaucg

SEQ ID NO: 4359 - RNA, 23 nt, Homo sapiens
ugauacagaacgaucgauacaga

SEQ ID NO: 4360 - RNA, 23 nt, Homo sapiens
uuaacagugcuaauguuauuggu

SEQ ID NO: 4361 - RNA, 23 nt, Homo sapiens
cagugcuaauguuauuggugucu

SEQ ID NO: 4362 - RNA, 23 nt, Homo sapiens
ucaacuauuuaugagauguaucu

SEQ ID NO: 4363 - RNA, 23 nt, Homo sapiens
gacagaacaguccuuaauccaga

SEQ ID NO: 4364 - RNA, 23 nt, Homo sapiens
aagacugauacagaacgaucgau

SEQ ID NO: 4365 - RNA, 23 nt, Homo sapiens
cuacagcacaacaaaugugaaug

SEQ ID NO: 4366 - RNA, 23 nt, Homo sapiens
uaaaauagacauugcuauucugu

SEQ ID NO: 4367 - RNA, 23 nt, Homo sapiens
guuauuggugucuucacuggaug

SEQ ID NO: 4368 - RNA, 23 nt, Homo sapiens
gacugauacagaacgaucgauac

SEQ ID NO: 4369 - RNA, 23 nt, Homo sapiens
uugcucucuuauuuguaccgguu

SEQ ID NO: 4370 - RNA, 23 nt, Homo sapiens
cacaccauugaaaccacuaguuc

SEQ ID NO: 4371 - RNA, 23 nt, Homo sapiens
gaggcagcuugaguuaaacgaac

SEQ ID NO: 4372 - RNA, 23 nt, Homo sapiens
aguuaaacgaacguacuugcaga

SEQ ID NO: 4373 - RNA, 23 nt, Homo sapiens
gaucggugacagucacuagcuua

SEQ ID NO: 4374 - RNA, 23 nt, Homo sapiens
ugaguuaaacgaacguacuugca

SEQ ID NO: 4375 - RNA, 23 nt, Homo sapiens
aggcagcuugaguuaaacgaacg

SEQ ID NO: 4376 - RNA, 23 nt, Homo sapiens
acagugcuaauguuauugguguc

SEQ ID NO: 4377 - RNA, 23 nt, Homo sapiens
cacgaaguggugaaguucaugga

SEQ ID NO: 4378 - RNA, 23 nt, Homo sapiens
agaaagcauuuguuuguacaaga

SEQ ID NO: 4379 - RNA, 23 nt, Homo sapiens
cuauguccucacaccauugaaac

SEQ ID NO: 4380 - RNA, 23 nt, Homo sapiens
cuugaguuaaacgaacguacuug

SEQ ID NO: 4381 - RNA, 23 nt, Homo sapiens
ucacaccauugaaaccacuaguu

SEQ ID NO: 4382 - RNA, 23 nt, Homo sapiens
ugcaaaaacacagacucgcguug

SEQ ID NO: 4383 - RNA, 23 nt, Homo sapiens
uauguccucacaccauugaaacc

SEQ ID NO: 4384 - RNA, 23 nt, Homo sapiens
ggcagcuugaguuaaacgaacgu

SEQ ID NO: 4385 - RNA, 23 nt, Homo sapiens
uuggugcuacuguuuauccguaa

SEQ ID NO: 4386 - RNA, 23 nt, Homo sapiens
ucuugcucucuuauuuguaccgg

SEQ ID NO: 4387 - RNA, 23 nt, Homo sapiens
uuucuugcugcuaaaucaccgag

SEQ ID NO: 4388 - RNA, 23 nt, Homo sapiens
uacgguacuuauuuaauaucccu

SEQ ID NO: 4389 - RNA, 23 nt, Homo sapiens
auaaaauagacauugcuauucug

SEQ ID NO: 4390 - RNA, 23 nt, Homo sapiens
aaacuuuucguccaacuucuggg

SEQ ID NO: 4391 - RNA, 23 nt, Homo sapiens
uauuggugcuacuguuuauccgu

SEQ ID NO: 4392 - RNA, 23 nt, Homo sapiens
auguuauuggugucuucacugga

SEQ ID NO: 4393 - RNA, 23 nt, Homo sapiens
uuuucguccaacuucugggcugu

SEQ ID NO: 4394 - RNA, 23 nt, Homo sapiens
uuuucuugcugcuaaaucaccga

SEQ ID NO: 4395 - RNA, 23 nt, Homo sapiens
acgguacuuauuuaauaucccuu

SEQ ID NO: 4396 - RNA, 23 nt, Homo sapiens
agauauuaacaucacgucuuugu

SEQ ID NO: 4397 - RNA, 23 nt, Homo sapiens
gcgaggcagcuugaguuaaacga

SEQ ID NO: 4398 - RNA, 23 nt, Homo sapiens
uggugcuacuguuuauccguaau

SEQ ID NO: 4399 - RNA, 23 nt, Homo sapiens
cgaggcagcuugaguuaaacgaa

SEQ ID NO: 4400 - RNA, 23 nt, Homo sapiens
auuggugcuacuguuuauccgua

SEQ ID NO: 4401 - RNA, 23 nt, Homo sapiens
gaaaggggcaaaaacgaaagcgc

SEQ ID NO: 4402 - RNA, 23 nt, Homo sapiens
ugacagucacuagcuuaucuuga

SEQ ID NO: 4403 - RNA, 23 nt, Homo sapiens
auacgguacuuauuuaauauccc

SEQ ID NO: 4404 - RNA, 23 nt, Homo sapiens
uugaguuaaacgaacguacuugc

SEQ ID NO: 4405 - RNA, 23 nt, Homo sapiens
aauguuauuggugucuucacugg

SEQ ID NO: 4406 - RNA, 23 nt, Homo sapiens
aucgacagaacaguccuuaaucc

SEQ ID NO: 4407 - RNA, 23 nt, Homo sapiens
aaaaaaucaguucgaggaaaggg

SEQ ID NO: 4408 - RNA, 23 nt, Homo sapiens
cucuuggaauuggauucgccauu

SEQ ID NO: 4409 - RNA, 23 nt, Homo sapiens
gaagagaagagacacauuguugg

SEQ ID NO: 4410 - RNA, 23 nt, Homo sapiens
ucacgucuuugucucuagugcag

SEQ ID NO: 4411 - RNA, 23 nt, Homo sapiens
ggugacagucacuagcuuaucuu

SEQ ID NO: 4412 - RNA, 23 nt, Homo sapiens
gcuugaguuaaacgaacguacuu

SEQ ID NO: 4413 - RNA, 23 nt, Homo sapiens
gagaaagcauuuguuuguacaag

SEQ ID NO: 4414 - RNA, 23 nt, Homo sapiens
acaucaccaugcagauuaugcgg

SEQ ID NO: 4415 - RNA, 23 nt, Homo sapiens
aucaccaugcagauuaugcggau

SEQ ID NO: 4416 - RNA, 23 nt, Homo sapiens
agcuugaguuaaacgaacguacu

SEQ ID NO: 4417 - RNA, 23 nt, Homo sapiens
acuugcagaugugacaagccgag

SEQ ID NO: 4418 - RNA, 23 nt, Homo sapiens
caacuauuuaugagauguaucuu

SEQ ID NO: 4419 - RNA, 23 nt, Homo sapiens
gguuuuuuuucaguauucuuggu

SEQ ID NO: 4420 - RNA, 23 nt, Homo sapiens
guguuuuauauacgguacuuauu

SEQ ID NO: 4421 - RNA, 23 nt, Homo sapiens
gagaaaguguuuuauauacggua

SEQ ID NO: 4422 - RNA, 23 nt, Homo sapiens
cuucacuggauguauuugacugc

SEQ ID NO: 4423 - RNA, 23 nt, Homo sapiens
cagcuugaguuaaacgaacguac

SEQ ID NO: 4424 - RNA, 23 nt, Homo sapiens
ggccuccgaaaccaugaacuuuc

SEQ ID NO: 4425 - RNA, 23 nt, Homo sapiens
aaaaaaaucaguucgaggaaagg

SEQ ID NO: 4426 - RNA, 23 nt, Homo sapiens
uagagaauucuacauacuaaauc

SEQ ID NO: 4427 - RNA, 23 nt, Homo sapiens
gcagauuaugcggaucaaaccuc

SEQ ID NO: 4428 - RNA, 23 nt, Homo sapiens
aaaaaucaguucgaggaaaggga

SEQ ID NO: 4429 - RNA, 23 nt, Homo sapiens
aagcauuuguuuguacaagaucc

SEQ ID NO: 4430 - RNA, 23 nt, Homo sapiens
aucacgaaguggugaaguucaug

SEQ ID NO: 4431 - RNA, 23 nt, Homo sapiens
cuuaauccagaaaccugaaauga

SEQ ID NO: 4432 - RNA, 23 nt, Homo sapiens
uacaucuucaagccauccugugu

SEQ ID NO: 4433 - RNA, 23 nt, Homo sapiens
ggugcuacuguuuauccguaaua

SEQ ID NO: 4434 - RNA, 23 nt, Homo sapiens
ucuugcugcuaaaucaccgagcc

SEQ ID NO: 4435 - RNA, 23 nt, Homo sapiens
aagauauuaacaucacgucuuug

SEQ ID NO: 4436 - RNA, 23 nt, Homo sapiens
uccugcaaaaacacagacucgcg

SEQ ID NO: 4437 - RNA, 23 nt, Homo sapiens
uucuugcugcuaaaucaccgagc

SEQ ID NO: 4438 - RNA, 23 nt, Homo sapiens
agagaaaguguuuuauauacggu

SEQ ID NO: 4439 - RNA, 23 nt, Homo sapiens
ccaacaucaccaugcagauuaug

SEQ ID NO: 4440 - RNA, 23 nt, Homo sapiens
uccgcagacguguaaauguuccu

SEQ ID NO: 4441 - RNA, 23 nt, Homo sapiens
gcagcuugaguuaaacgaacgua

SEQ ID NO: 4442 - RNA, 23 nt, Homo sapiens
ucgcacugaaacuuuucguccaa

SEQ ID NO: 4443 - RNA, 23 nt, Homo sapiens
agaauucuacauacuaaaucucu

SEQ ID NO: 4444 - RNA, 23 nt, Homo sapiens
auccgcagacguguaaauguucc

SEQ ID NO: 4445 - RNA, 23 nt, Homo sapiens
gauccgcagacguguaaauguuc

SEQ ID NO: 4446 - RNA, 23 nt, Homo sapiens
gucgcacugaaacuuuucgucca

SEQ ID NO: 4447 - RNA, 23 nt, Homo sapiens
gucccucuuggaauuggauucgc

SEQ ID NO: 4448 - RNA, 23 nt, Homo sapiens
cgcagacguguaaauguuccugc

SEQ ID NO: 4449 - RNA, 23 nt, Homo sapiens
aaacgaacguacuugcagaugug

SEQ ID NO: 4450 - RNA, 23 nt, Homo sapiens
agauccgcagacguguaaauguu

SEQ ID NO: 4451 - RNA, 23 nt, Homo sapiens
ggcagaaucaucacgaaguggug

SEQ ID NO: 4452 - RNA, 23 nt, Homo sapiens
uuccugcaaaaacacagacucgc

SEQ ID NO: 4453 - RNA, 23 nt, Homo sapiens
ucaggacauugcugugcuuuggg

SEQ ID NO: 4454 - RNA, 23 nt, Homo sapiens
gagggcagaaucaucacgaagug

SEQ ID NO: 4455 - RNA, 23 nt, Homo sapiens
ggugaaguucauggaugucuauc

SEQ ID NO: 4456 - RNA, 23 nt, Homo sapiens
ggcgucgcacugaaacuuuucgu

SEQ ID NO: 4457 - RNA, 23 nt, Homo sapiens
aagaaaaaaaaucaguucgagga

SEQ ID NO: 4458 - RNA, 23 nt, Homo sapiens
uuauuggugucuucacuggaugu

SEQ ID NO: 4459 - RNA, 23 nt, Homo sapiens
caagauccgcagacguguaaaug

SEQ ID NO: 4460 - RNA, 23 nt, Homo sapiens
aagauccgcagacguguaaaugu

SEQ ID NO: 4461 - RNA, 23 nt, Homo sapiens
auuuguuuguacaagauccgcag

SEQ ID NO: 4462 - RNA, 23 nt, Homo sapiens
acugcuguggacuugaguuggga

SEQ ID NO: 4463 - RNA, 23 nt, Homo sapiens
aucacgucuuugucucuagugca

SEQ ID NO: 4464 - RNA, 23 nt, Homo sapiens
guuuuuuuucaguauucuugguu

SEQ ID NO: 4465 - RNA, 23 nt, Homo sapiens
cggugcuggaauuugauauucau

SEQ ID NO: 4466 - RNA, 23 nt, Homo sapiens
uauuaacaucacgucuuugucuc

SEQ ID NO: 4467 - RNA, 23 nt, Homo sapiens
aaaggggcaaaaacgaaagcgca

SEQ ID NO: 4468 - RNA, 23 nt, Homo sapiens
gcaaagugagugaccugcuuuug

SEQ ID NO: 4469 - RNA, 23 nt, Homo sapiens
gcaaaaacacagacucgcguugc

SEQ ID NO: 4470 - RNA, 23 nt, Homo sapiens
gcauuuguuuguacaagauccgc

SEQ ID NO: 4471 - RNA, 23 nt, Homo sapiens
acuuccccaaaucacuguggauu

SEQ ID NO: 4472 - RNA, 23 nt, Homo sapiens
auauuaacaucacgucuuugucu

SEQ ID NO: 4473 - RNA, 23 nt, Homo sapiens
cacgucuuugucucuagugcagu

SEQ ID NO: 4474 - RNA, 23 nt, Homo sapiens
caaaaacacagacucgcguugca

SEQ ID NO: 4475 - RNA, 23 nt, Homo sapiens
ccugcaaaaacacagacucgcgu

SEQ ID NO: 4476 - RNA, 23 nt, Homo sapiens
aaaacacagacucgcguugcaag

SEQ ID NO: 4477 - RNA, 23 nt, Homo sapiens
uacuugcagaugugacaagccga

SEQ ID NO: 4478 - RNA, 23 nt, Homo sapiens
uguuuauccguaauaauuguggg

SEQ ID NO: 4479 - RNA, 23 nt, Homo sapiens
cugcaaaaacacagacucgcguu

SEQ ID NO: 4480 - RNA, 23 nt, Homo sapiens
cuguuuauccguaauaauugugg

SEQ ID NO: 4481 - RNA, 23 nt, Homo sapiens
aggggcaaaaacgaaagcgcaag

SEQ ID NO: 4482 - RNA, 23 nt, Homo sapiens
guuuauccguaauaauugugggg

SEQ ID NO: 4483 - RNA, 23 nt, Homo sapiens
auaaaauagacauugcuauucug

SEQ ID NO: 4484 - RNA, 23 nt, Homo sapiens
acagugcuaauguuauugguguc

SEQ ID NO: 4485 - RNA, 23 nt, Homo sapiens
ugauacagaacgaucgauacaga

SEQ ID NO: 4486 - RNA, 23 nt, Homo sapiens
cuacagcacaacaaaugugaaug

SEQ ID NO: 4487 - RNA, 23 nt, Homo sapiens
gacugauacagaacgaucgauac

SEQ ID NO: 4488 - RNA, 23 nt, Homo sapiens
aagagaaaguguuuuauauacgg

SEQ ID NO: 4489 - RNA, 23 nt, Homo sapiens
ucaacuauuuaugagauguaucu

SEQ ID NO: 4490 - RNA, 23 nt, Homo sapiens
gaaagacugauacagaacgaucg

SEQ ID NO: 4491 - RNA, 23 nt, Homo sapiens
uagagaauucuacauacuaaauc

SEQ ID NO: 4492 - RNA, 23 nt, Homo sapiens
ggaaagacugauacagaacgauc

SEQ ID NO: 4493 - RNA, 23 nt, Homo sapiens
auacgguacuuauuuaauauccc

SEQ ID NO: 4494 - RNA, 23 nt, Homo sapiens
agacugauacagaacgaucgaua

SEQ ID NO: 4495 - RNA, 23 nt, Homo sapiens
aucgacagaacaguccuuaaucc

SEQ ID NO: 4496 - RNA, 23 nt, Homo sapiens
gacagaacaguccuuaauccaga

SEQ ID NO: 4497 - RNA, 23 nt, Homo sapiens
uuaacagugcuaauguuauuggu

SEQ ID NO: 4498 - RNA, 23 nt, Homo sapiens
ugacagucacuagcuuaucuuga

SEQ ID NO: 4499 - RNA, 23 nt, Homo sapiens
uucuugcugcuaaaucaccgagc

SEQ ID NO: 4500 - RNA, 23 nt, Homo sapiens
gagaaaguguuuuauauacggua

SEQ ID NO: 4501 - RNA, 23 nt, Homo sapiens
uugcucucuuauuuguaccgguu

SEQ ID NO: 4502 - RNA, 23 nt, Homo sapiens
uuuucuugcugcuaaaucaccga

SEQ ID NO: 4503 - RNA, 23 nt, Homo sapiens
cacaccauugaaaccacuaguuc

SEQ ID NO: 4504 - RNA, 23 nt, Homo sapiens
uacgguacuuauuuaauaucccu

SEQ ID NO: 4505 - RNA, 23 nt, Homo sapiens
uucaacuauuuaugagauguauc

SEQ ID NO: 4506 - RNA, 23 nt, Homo sapiens
cuuaauccagaaaccugaaauga

SEQ ID NO: 4507 - RNA, 23 nt, Homo sapiens
uaaaauagacauugcuauucugu

SEQ ID NO: 4508 - RNA, 23 nt, Homo sapiens
agaaagcauuuguuuguacaaga

SEQ ID NO: 4509 - RNA, 23 nt, Homo sapiens
cucuuggaauuggauucgccauu

SEQ ID NO: 4510 - RNA, 23 nt, Homo sapiens
ucacaccauugaaaccacuaguu

SEQ ID NO: 4511 - RNA, 23 nt, Homo sapiens
ccaacaucaccaugcagauuaug

SEQ ID NO: 4512 - RNA, 23 nt, Homo sapiens
ggugacagucacuagcuuaucuu

SEQ ID NO: 4513 - RNA, 23 nt, Homo sapiens
ugaguuaaacgaacguacuugca

SEQ ID NO: 4514 - RNA, 23 nt, Homo sapiens
caacuauuuaugagauguaucuu

SEQ ID NO: 4515 - RNA, 23 nt, Homo sapiens
aguuaaacgaacguacuugcaga

SEQ ID NO: 4516 - RNA, 23 nt, Homo sapiens
acgguacuuauuuaauaucccuu

SEQ ID NO: 4517 - RNA, 23 nt, Homo sapiens
cacgaaguggugaaguucaugga

SEQ ID NO: 4518 - RNA, 23 nt, Homo sapiens
aauguuauuggugucuucacugg

SEQ ID NO: 4519 - RNA, 23 nt, Homo sapiens
ucuugcucucuuauuuguaccgg

SEQ ID NO: 4520 - RNA, 23 nt, Homo sapiens
guguuuuauauacgguacuuauu

SEQ ID NO: 4521 - RNA, 23 nt, Homo sapiens
cuucacuggauguauuugacugc

SEQ ID NO: 4522 - RNA, 23 nt, Homo sapiens
ggccuccgaaaccaugaacuuuc

SEQ ID NO: 4523 - RNA, 23 nt, Homo sapiens
guuauuggugucuucacuggaug

SEQ ID NO: 4524 - RNA, 23 nt, Homo sapiens
aaagacugauacagaacgaucga

SEQ ID NO: 4525 - RNA, 23 nt, Homo sapiens
gauccgcagacguguaaauguuc

SEQ ID NO: 4526 - RNA, 23 nt, Homo sapiens
uugaguuaaacgaacguacuugc

SEQ ID NO: 4527 - RNA, 23 nt, Homo sapiens
agagaaaguguuuuauauacggu

SEQ ID NO: 4528 - RNA, 23 nt, Homo sapiens
auguuauuggugucuucacugga

SEQ ID NO: 4529 - RNA, 23 nt, Homo sapiens
agcuugaguuaaacgaacguacu

SEQ ID NO: 4530 - RNA, 23 nt, Homo sapiens
cuugaguuaaacgaacguacuug

SEQ ID NO: 4531 - RNA, 23 nt, Homo sapiens
acaucaccaugcagauuaugcgg

SEQ ID NO: 4532 - RNA, 23 nt, Homo sapiens
gcuugaguuaaacgaacguacuu

SEQ ID NO: 4533 - RNA, 23 nt, Homo sapiens
aggcagcuugaguuaaacgaacg

SEQ ID NO: 4534 - RNA, 23 nt, Homo sapiens
gucgcacugaaacuuuucgucca

SEQ ID NO: 4535 - RNA, 23 nt, Homo sapiens
gaucggugacagucacuagcuua

SEQ ID NO: 4536 - RNA, 23 nt, Homo sapiens
cagugcuaauguuauuggugucu

SEQ ID NO: 4537 - RNA, 23 nt, Homo sapiens
uccgcagacguguaaauguuccu

SEQ ID NO: 4538 - RNA, 23 nt, Homo sapiens
gaagagaagagacacauuguugg

SEQ ID NO: 4539 - RNA, 23 nt, Homo sapiens
ggugaaguucauggaugucuauc

SEQ ID NO: 4540 - RNA, 23 nt, Homo sapiens
agaauucuacauacuaaaucucu

SEQ ID NO: 4541 - RNA, 23 nt, Homo sapiens
cgcagacguguaaauguuccugc

SEQ ID NO: 4542 - RNA, 23 nt, Homo sapiens
aucacgaaguggugaaguucaug

SEQ ID NO: 4543 - RNA, 23 nt, Homo sapiens
cagcuugaguuaaacgaacguac

SEQ ID NO: 4544 - RNA, 23 nt, Homo sapiens
uacaucuucaagccauccugugu

SEQ ID NO: 4545 - RNA, 23 nt, Homo sapiens
aucaccaugcagauuaugcggau

SEQ ID NO: 4546 - RNA, 23 nt, Homo sapiens
gaggcagcuugaguuaaacgaac

SEQ ID NO: 4547 - RNA, 23 nt, Homo sapiens
cuauguccucacaccauugaaac

SEQ ID NO: 4548 - RNA, 23 nt, Homo sapiens
auccgcagacguguaaauguucc

SEQ ID NO: 4549 - RNA, 23 nt, Homo sapiens
ggcagaaucaucacgaaguggug

SEQ ID NO: 4550 - RNA, 23 nt, Homo sapiens
uggugcuacuguuuauccguaau

SEQ ID NO: 4551 - RNA, 23 nt, Homo sapiens
uauguccucacaccauugaaacc

SEQ ID NO: 4552 - RNA, 23 nt, Homo sapiens
uccugcaaaaacacagacucgcg

SEQ ID NO: 4553 - RNA, 23 nt, Homo sapiens
gcgaggcagcuugaguuaaacga

SEQ ID NO: 4554 - RNA, 23 nt, Homo sapiens
agauccgcagacguguaaauguu

SEQ ID NO: 4555 - RNA, 23 nt, Homo sapiens
aagcauuuguuuguacaagaucc

SEQ ID NO: 4556 - RNA, 23 nt, Homo sapiens
gagaaagcauuuguuuguacaag

SEQ ID NO: 4557 - RNA, 23 nt, Homo sapiens
auuggugcuacuguuuauccgua

SEQ ID NO: 4558 - RNA, 23 nt, Homo sapiens
cgaggcagcuugaguuaaacgaa

SEQ ID NO: 4559 - RNA, 23 nt, Homo sapiens
ucgcacugaaacuuuucguccaa

SEQ ID NO: 4560 - RNA, 23 nt, Homo sapiens
aagacugauacagaacgaucgau

SEQ ID NO: 4561 - RNA, 23 nt, Homo sapiens
aaacgaacguacuugcagaugug

SEQ ID NO: 4562 - RNA, 23 nt, Homo sapiens
ggcagcuugaguuaaacgaacgu

SEQ ID NO: 4563 - RNA, 23 nt, Homo sapiens
gcagcuugaguuaaacgaacgua

SEQ ID NO: 4564 - RNA, 23 nt, Homo sapiens
aagauauuaacaucacgucuuug

SEQ ID NO: 4565 - RNA, 23 nt, Homo sapiens
uuccugcaaaaacacagacucgc

SEQ ID NO: 4566 - RNA, 23 nt, Homo sapiens
cggugcuggaauuugauauucau

SEQ ID NO: 4567 - RNA, 23 nt, Homo sapiens
uauuggugcuacuguuuauccgu

SEQ ID NO: 4568 - RNA, 23 nt, Homo sapiens
uuauuggugucuucacuggaugu

SEQ ID NO: 4569 - RNA, 23 nt, Homo sapiens
uuucuugcugcuaaaucaccgag

SEQ ID NO: 4570 - RNA, 23 nt, Homo sapiens
ucuugcugcuaaaucaccgagcc

SEQ ID NO: 4571 - RNA, 23 nt, Homo sapiens
gcagauuaugcggaucaaaccuc

SEQ ID NO: 4572 - RNA, 23 nt, Homo sapiens
gagggcagaaucaucacgaagug

SEQ ID NO: 4573 - RNA, 23 nt, Homo sapiens
gcauuuguuuguacaagauccgc

SEQ ID NO: 4574 - RNA, 23 nt, Homo sapiens
ugcaaaaacacagacucgcguug

SEQ ID NO: 4575 - RNA, 23 nt, Homo sapiens
ggugcuacuguuuauccguaaua

SEQ ID NO: 4576 - RNA, 23 nt, Homo sapiens
aaacuuuucguccaacuucuggg

SEQ ID NO: 4577 - RNA, 23 nt, Homo sapiens
uuggugcuacuguuuauccguaa

SEQ ID NO: 4578 - RNA, 23 nt, Homo sapiens
cugcaaaaacacagacucgcguu

SEQ ID NO: 4579 - RNA, 23 nt, Homo sapiens
ggcgucgcacugaaacuuuucgu

SEQ ID NO: 4580 - RNA, 23 nt, Homo sapiens
agauauuaacaucacgucuuugu

SEQ ID NO: 4581 - RNA, 23 nt, Homo sapiens
caaaaacacagacucgcguugca

SEQ ID NO: 4582 - RNA, 23 nt, Homo sapiens
uacuugcagaugugacaagccga

SEQ ID NO: 4583 - RNA, 23 nt, Homo sapiens
gguuuuuuuucaguauucuuggu

SEQ ID NO: 4584 - RNA, 23 nt, Homo sapiens
gcaaagugagugaccugcuuuug

SEQ ID NO: 4585 - RNA, 23 nt, Homo sapiens
uuuucguccaacuucugggcugu

SEQ ID NO: 4586 - RNA, 23 nt, Homo sapiens
ucaggacauugcugugcuuuggg

SEQ ID NO: 4587 - RNA, 23 nt, Homo sapiens
aaaaaucaguucgaggaaaggga

SEQ ID NO: 4588 - RNA, 23 nt, Homo sapiens
acuuccccaaaucacuguggauu

SEQ ID NO: 4589 - RNA, 23 nt, Homo sapiens
gucccucuuggaauuggauucgc

SEQ ID NO: 4590 - RNA, 23 nt, Homo sapiens
acuugcagaugugacaagccgag

SEQ ID NO: 4591 - RNA, 23 nt, Homo sapiens
aucacgucuuugucucuagugca

SEQ ID NO: 4592 - RNA, 23 nt, Homo sapiens
aagauccgcagacguguaaaugu

SEQ ID NO: 4593 - RNA, 23 nt, Homo sapiens
aaaaaaaucaguucgaggaaagg

SEQ ID NO: 4594 - RNA, 23 nt, Homo sapiens
acugcuguggacuugaguuggga

SEQ ID NO: 4595 - RNA, 23 nt, Homo sapiens
gaaaggggcaaaaacgaaagcgc

SEQ ID NO: 4596 - RNA, 23 nt, Homo sapiens
ccugcaaaaacacagacucgcgu

SEQ ID NO: 4597 - RNA, 23 nt, Homo sapiens
ucacgucuuugucucuagugcag

SEQ ID NO: 4598 - RNA, 23 nt, Homo sapiens
aggggcaaaaacgaaagcgcaag

SEQ ID NO: 4599 - RNA, 23 nt, Homo sapiens
aaaggggcaaaaacgaaagcgca

SEQ ID NO: 4600 - RNA, 23 nt, Homo sapiens
aagaaaaaaaaucaguucgagga

SEQ ID NO: 4601 - RNA, 23 nt, Homo sapiens
aaaaaaucaguucgaggaaaggg

SEQ ID NO: 4602 - RNA, 23 nt, Homo sapiens
gcaaaaacacagacucgcguugc

SEQ ID NO: 4603 - RNA, 23 nt, Homo sapiens
uguuuauccguaauaauuguggg

SEQ ID NO: 4604 - RNA, 23 nt, Homo sapiens
caagauccgcagacguguaaaug

SEQ ID NO: 4605 - RNA, 23 nt, Homo sapiens
uauuaacaucacgucuuugucuc

SEQ ID NO: 4606 - RNA, 23 nt, Homo sapiens
cacgucuuugucucuagugcagu

SEQ ID NO: 4607 - RNA, 23 nt, Homo sapiens
cuguuuauccguaauaauugugg

SEQ ID NO: 4608 - RNA, 23 nt, Homo sapiens
auuuguuuguacaagauccgcag

SEQ ID NO: 4609 - RNA, 23 nt, Homo sapiens
guuuauccguaauaauugugggg

SEQ ID NO: 4610 - RNA, 23 nt, Homo sapiens
aaaacacagacucgcguugcaag

SEQ ID NO: 4611 - RNA, 23 nt, Homo sapiens
guuuuuuuucaguauucuugguu

SEQ ID NO: 4612 - RNA, 23 nt, Homo sapiens
auauuaacaucacgucuuugucu

SEQ ID NO: 4613 - RNA, 23 nt, Rattus norvegicus
cacggaaacuuuucguccaacuu

SEQ ID NO: 4614 - RNA, 23 nt, Rattus norvegicus
acggaaacuuuucguccaacuuc

SEQ ID NO: 4615 - RNA, 23 nt, Rattus norvegicus
gucgacagaacaguccuuaaucc

SEQ ID NO: 4616 - RNA, 23 nt, Rattus norvegicus
cucugcuaauguuauuggugucu

SEQ ID NO: 4617 - RNA, 23 nt, Rattus norvegicus
uuuccgagauauuccguaguaca

SEQ ID NO: 4618 - RNA, 23 nt, Rattus norvegicus
uccgagauauuccguaguacaua

SEQ ID NO: 4619 - RNA, 23 nt, Rattus norvegicus
uugcacggaaacuuuucguccaa

SEQ ID NO: 4620 - RNA, 23 nt, Rattus norvegicus
ugcacggaaacuuuucguccaac

SEQ ID NO: 4621 - RNA, 23 nt, Rattus norvegicus
ccgagauauuccguaguacauau

SEQ ID NO: 4622 - RNA, 23 nt, Rattus norvegicus
auuuguuuguccaagauccgcag

SEQ ID NO: 4623 - RNA, 23 nt, Rattus norvegicus
gcacggaaacuuuucguccaacu

SEQ ID NO: 4624 - RNA, 23 nt, Rattus norvegicus
agaucaugcggaucaaaccucac

SEQ ID NO: 4625 - RNA, 23 nt, Rattus norvegicus
ucaugcggaucaaaccucaccaa

SEQ ID NO: 4626 - RNA, 23 nt, Rattus norvegicus
cagaucaugcggaucaaaccuca

SEQ ID NO: 4627 - RNA, 23 nt, Rattus norvegicus
cauuuguuuguccaagauccgca

SEQ ID NO: 4628 - RNA, 23 nt, Rattus norvegicus
cagaucggugacagucacuagcu

SEQ ID NO: 4629 - RNA, 23 nt, Rattus norvegicus
ccaagauccgcagacguguaaau

SEQ ID NO: 4630 - RNA, 23 nt, Rattus norvegicus
uuuguccaagauccgcagacgug

SEQ ID NO: 4631 - RNA, 23 nt, Rattus norvegicus
acaucacgucuuugucucuagag

SEQ ID NO: 4632 - RNA, 23 nt, Rattus norvegicus
ucugaaaccaugaacuuucugcu

SEQ ID NO: 4633 - RNA, 23 nt, Rattus norvegicus
cuuugucucuagagcaguuuucc

SEQ ID NO: 4634 - RNA, 23 nt, Rattus norvegicus
cucacuuccagaaacacgacaaa

SEQ ID NO: 4635 - RNA, 23 nt, Rattus norvegicus
uaugaaaucuguguuuccaaucu

SEQ ID NO: 4636 - RNA, 23 nt, Rattus norvegicus
augaaaucuguguuuccaaucuc

SEQ ID NO: 4637 - RNA, 23 nt, Rattus norvegicus
ucuuugucucuagagcaguuuuc

SEQ ID NO: 4638 - RNA, 23 nt, Rattus norvegicus
uuugucucuagagcaguuuuccg

SEQ ID NO: 4639 - RNA, 23 nt, Rattus norvegicus
uaaacuguauuguuuuacgcuuu

SEQ ID NO: 4640 - RNA, 23 nt, Rattus norvegicus
aaacuguauuguuuuacgcuuua

SEQ ID NO: 4641 - RNA, 23 nt, Rattus norvegicus
aacuguauuguuuuacgcuuuaa

SEQ ID NO: 4642 - RNA, 23 nt, Rattus norvegicus
acuguauuguuuuacgcuuuaau

SEQ ID NO: 4643 - RNA, 23 nt, Rattus norvegicus
ccauugaaaccacuaauucuguc

SEQ ID NO: 4644 - RNA, 23 nt, Rattus norvegicus
guacuuauuuaauagcccuuuuu

SEQ ID NO: 4645 - RNA, 23 nt, Rattus norvegicus
ugucucuagagcaguuuuccgag

SEQ ID NO: 4646 - RNA, 23 nt, Rattus norvegicus
uuccgagauauuccguaguacau

SEQ ID NO: 4647 - RNA, 23 nt, Rattus norvegicus
gcucugggauuugauauucaaac

SEQ ID NO: 4648 - RNA, 23 nt, Rattus norvegicus
ucuucacuggauauguuugacug

SEQ ID NO: 4649 - RNA, 23 nt, Rattus norvegicus
uuggcucacuuccagaaacacga

SEQ ID NO: 4650 - RNA, 23 nt, Rattus norvegicus
cacuuccagaaacacgacaaacc

SEQ ID NO: 4651 - RNA, 23 nt, Rattus norvegicus
cagaccauugaaaccacuaauuc

SEQ ID NO: 4652 - RNA, 23 nt, Rattus norvegicus
acagucacuagcuuguccugaga

SEQ ID NO: 4653 - RNA, 23 nt, Rattus norvegicus
ccaccacacauuccuuugaaaua

SEQ ID NO: 4654 - RNA, 23 nt, Rattus norvegicus
ucaccggaaagaccgauuaacca

SEQ ID NO: 4655 - RNA, 23 nt, Rattus norvegicus
aaagaccgauuaaccaugucacc

SEQ ID NO: 4656 - RNA, 23 nt, Rattus norvegicus
gucuucacuggauauguuugacu

SEQ ID NO: 4657 - RNA, 23 nt, Rattus norvegicus
cguuggcucacuuccagaaacac

SEQ ID NO: 4658 - RNA, 23 nt, Rattus norvegicus
ggcucacuuccagaaacacgaca

SEQ ID NO: 4659 - RNA, 23 nt, Rattus norvegicus
cggugacagucacuagcuugucc

SEQ ID NO: 4660 - RNA, 23 nt, Rattus norvegicus
uugucucuagagcaguuuuccga

SEQ ID NO: 4661 - RNA, 23 nt, Rattus norvegicus
gucucuagagcaguuuuccgaga

SEQ ID NO: 4662 - RNA, 23 nt, Rattus norvegicus
caguuuuccgagauauuccguag

SEQ ID NO: 4663 - RNA, 23 nt, Rattus norvegicus
uuuuccgagauauuccguaguac

SEQ ID NO: 4664 - RNA, 23 nt, Rattus norvegicus
ucuuaaacuguauuguuuuacgc

SEQ ID NO: 4665 - RNA, 23 nt, Rattus norvegicus
uuaaacuguauuguuuuacgcuu

SEQ ID NO: 4666 - RNA, 23 nt, Rattus norvegicus
uggauucgccauuuucuuauauu

SEQ ID NO: 4667 - RNA, 23 nt, Rattus norvegicus
cuucacuggauauguuugacugc

SEQ ID NO: 4668 - RNA, 23 nt, Rattus norvegicus
acguuggcucacuuccagaaaca

SEQ ID NO: 4669 - RNA, 23 nt, Rattus norvegicus
ucacuuccagaaacacgacaaac

SEQ ID NO: 4670 - RNA, 23 nt, Rattus norvegicus
gguacuuauuuaauagcccuuuu

SEQ ID NO: 4671 - RNA, 23 nt, Rattus norvegicus
cuagagcaguuuuccgagauauu

SEQ ID NO: 4672 - RNA, 23 nt, Rattus norvegicus
ucugggauuugauauucaaaccu

SEQ ID NO: 4673 - RNA, 23 nt, Rattus norvegicus
cugggauuugauauucaaaccuc

SEQ ID NO: 4674 - RNA, 23 nt, Rattus norvegicus
gggauuugauauucaaaccucuu

SEQ ID NO: 4675 - RNA, 23 nt, Rattus norvegicus
cuuaaacuguauuguuuuacgcu

SEQ ID NO: 4676 - RNA, 23 nt, Rattus norvegicus
ucucaccggaaagaccgauuaac

SEQ ID NO: 4677 - RNA, 23 nt, Rattus norvegicus
cucaccggaaagaccgauuaacc

SEQ ID NO: 4678 - RNA, 23 nt, Rattus norvegicus
caccggaaagaccgauuaaccau

SEQ ID NO: 4679 - RNA, 23 nt, Rattus norvegicus
uggaacuggauucgccauuuucu

SEQ ID NO: 4680 - RNA, 23 nt, Rattus norvegicus
uucacuggauauguuugacugcu

SEQ ID NO: 4681 - RNA, 23 nt, Rattus norvegicus
gaggaccuugugugaucagacca

SEQ ID NO: 4682 - RNA, 23 nt, Rattus norvegicus
gaucagaccauugaaaccacuaa

SEQ ID NO: 4683 - RNA, 23 nt, Rattus norvegicus
accauugaaaccacuaauucugu

SEQ ID NO: 4684 - RNA, 23 nt, Rattus norvegicus
cucuagagcaguuuuccgagaua

SEQ ID NO: 4685 - RNA, 23 nt, Rattus norvegicus
ucuagagcaguuuuccgagauau

SEQ ID NO: 4686 - RNA, 23 nt, Rattus norvegicus
gcaguuuuccgagauauuccgua

SEQ ID NO: 4687 - RNA, 23 nt, Rattus norvegicus
augcggaucaaaccucaccaaag

SEQ ID NO: 4688 - RNA, 23 nt, Rattus norvegicus
aaagcauuuguuuguccaagauc

SEQ ID NO: 4689 - RNA, 23 nt, Rattus norvegicus
ccucucaccggaaagaccgauua

SEQ ID NO: 4690 - RNA, 23 nt, Rattus norvegicus
ucucuagagcaguuuuccgagau

SEQ ID NO: 4691 - RNA, 23 nt, Rattus norvegicus
ggauugcacggaaacuuuucguc

SEQ ID NO: 4692 - RNA, 23 nt, Rattus norvegicus
gugcucugggauuugauauucaa

SEQ ID NO: 4693 - RNA, 23 nt, Rattus norvegicus
ugugagccuuguucagagcggag

SEQ ID NO: 4694 - RNA, 23 nt, Rattus norvegicus
ugagccuuguucagagcggagaa

SEQ ID NO: 4695 - RNA, 23 nt, Rattus norvegicus
agcauuuguuuguccaagauccg

SEQ ID NO: 4696 - RNA, 23 nt, Rattus norvegicus
ccggaaagaccgauuaaccaugu

SEQ ID NO: 4697 - RNA, 23 nt, Rattus norvegicus
cggaaagaccgauuaaccauguc

SEQ ID NO: 4698 - RNA, 23 nt, Rattus norvegicus
gaaagaccgauuaaccaugucac

SEQ ID NO: 4699 - RNA, 23 nt, Rattus norvegicus
aagaccgauuaaccaugucacca

SEQ ID NO: 4700 - RNA, 23 nt, Homo sapiens
cucggugcuggaauuugauauuc

SEQ ID NO: 4701 - RNA, 23 nt, Homo sapiens
ucggugcuggaauuugauauuca

SEQ ID NO: 4702 - RNA, 23 nt, Homo sapiens
ggugcuggaauuugauauucauu

SEQ ID NO: 4703 - RNA, 23 nt, Homo sapiens
gugcuggaauuugauauucauug

SEQ ID NO: 4704 - RNA, 23 nt, Homo sapiens
gcuggaauuugauauucauugau

SEQ ID NO: 4705 - RNA, 23 nt, Homo sapiens
cuggaauuugauauucauugauc

SEQ ID NO: 4706 - RNA, 23 nt, Homo sapiens
uggaauuugauauucauugaucc

SEQ ID NO: 4707 - RNA, 23 nt, Homo sapiens
ggaauuugauauucauugauccg

SEQ ID NO: 4708 - RNA, 23 nt, Homo sapiens
gaauuugauauucauugauccgg

SEQ ID NO: 4709 - RNA, 23 nt, Homo sapiens
aauuugauauucauugauccggg

SEQ ID NO: 4710 - RNA, 23 nt, Homo sapiens
aauuuauuuuugcuugccauucc

SEQ ID NO: 4711 - RNA, 23 nt, Homo sapiens
auuuauuuuugcuugccauuccc

SEQ ID NO: 4712 - RNA, 23 nt, Homo sapiens
cccaaaucacuguggauuuugga

SEQ ID NO: 4713 - RNA, 23 nt, Homo sapiens
ccaaaucacuguggauuuuggaa

SEQ ID NO: 4714 - RNA, 23 nt, Homo sapiens
caaaucacuguggauuuuggaaa

SEQ ID NO: 4715 - RNA, 23 nt, Homo sapiens
aaaucacuguggauuuuggaaac

SEQ ID NO: 4716 - RNA, 23 nt, Homo sapiens
aaucacuguggauuuuggaaacc

SEQ ID NO: 4717 - RNA, 23 nt, Homo sapiens
aucacuguggauuuuggaaacca

SEQ ID NO: 4718 - RNA, 23 nt, Homo sapiens
ucacuguggauuuuggaaaccag

SEQ ID NO: 4719 - RNA, 23 nt, Homo sapiens
cacuguggauuuuggaaaccagc

SEQ ID NO: 4720 - RNA, 23 nt, Homo sapiens
acuguggauuuuggaaaccagca

SEQ ID NO: 4721 - RNA, 23 nt, Homo sapiens
cuguggauuuuggaaaccagcag

SEQ ID NO: 4722 - RNA, 23 nt, Homo sapiens
uggauuuuggaaaccagcagaaa

SEQ ID NO: 4723 - RNA, 23 nt, Homo sapiens
ggauuuuggaaaccagcagaaag

SEQ ID NO: 4724 - RNA, 23 nt, Homo sapiens
gauuuuggaaaccagcagaaaga

SEQ ID NO: 4725 - RNA, 23 nt, Homo sapiens
auuuuggaaaccagcagaaagag

SEQ ID NO: 4726 - RNA, 23 nt, Homo sapiens
uuggaaaccagcagaaagaggaa

SEQ ID NO: 4727 - RNA, 23 nt, Homo sapiens
ggaaaccagcagaaagaggaaag

SEQ ID NO: 4728 - RNA, 23 nt, Homo sapiens
gaaaccagcagaaagaggaaaga

SEQ ID NO: 4729 - RNA, 23 nt, Homo sapiens
aaaccagcagaaagaggaaagag

SEQ ID NO: 4730 - RNA, 23 nt, Homo sapiens
aaccagcagaaagaggaaagagg

SEQ ID NO: 4731 - RNA, 23 nt, Homo sapiens
accagcagaaagaggaaagaggu

SEQ ID NO: 4732 - RNA, 23 nt, Homo sapiens
ccagcagaaagaggaaagaggua

SEQ ID NO: 4733 - RNA, 23 nt, Homo sapiens
cagcagaaagaggaaagagguag

SEQ ID NO: 4734 - RNA, 23 nt, Homo sapiens
agcagaaagaggaaagagguagc

SEQ ID NO: 4735 - RNA, 23 nt, Homo sapiens
agaaagaggaaagagguagcaag

SEQ ID NO: 4736 - RNA, 23 nt, Homo sapiens
gaaagaggaaagagguagcaaga

SEQ ID NO: 4737 - RNA, 23 nt, Homo sapiens
aaagaggaaagagguagcaagag

SEQ ID NO: 4738 - RNA, 23 nt, Homo sapiens
aagaggaaagagguagcaagagc

SEQ ID NO: 4739 - RNA, 23 nt, Homo sapiens
gaggaaagagguagcaagagcuc

SEQ ID NO: 4740 - RNA, 23 nt, Homo sapiens
agagguagcaagagcuccagaga

SEQ ID NO: 4741 - RNA, 23 nt, Homo sapiens
gcuccagagagaagucgaggaag

SEQ ID NO: 4742 - RNA, 23 nt, Homo sapiens
cuccagagagaagucgaggaaga

SEQ ID NO: 4743 - RNA, 23 nt, Homo sapiens
uccagagagaagucgaggaagag

SEQ ID NO: 4744 - RNA, 23 nt, Homo sapiens
agagagaagucgaggaagagaga

SEQ ID NO: 4745 - RNA, 23 nt, Homo sapiens
gagagaagucgaggaagagagag

SEQ ID NO: 4746 - RNA, 23 nt, Homo sapiens
gagaagucgaggaagagagagac

SEQ ID NO: 4747 - RNA, 23 nt, Homo sapiens
aaagugagugaccugcuuuuggg

SEQ ID NO: 4748 - RNA, 23 nt, Homo sapiens
gcggcgucgcacugaaacuuuuc

SEQ ID NO: 4749 - RNA, 23 nt, Homo sapiens
gcgucgcacugaaacuuuucguc

SEQ ID NO: 4750 - RNA, 23 nt, Homo sapiens
cgucgcacugaaacuuuucgucc

SEQ ID NO: 4751 - RNA, 23 nt, Homo sapiens
cgcacugaaacuuuucguccaac

SEQ ID NO: 4752 - RNA, 23 nt, Homo sapiens
gcacugaaacuuuucguccaacu

SEQ ID NO: 4753 - RNA, 23 nt, Homo sapiens
acugaaacuuuucguccaacuuc

SEQ ID NO: 4754 - RNA, 23 nt, Homo sapiens
gaaacuuuucguccaacuucugg

SEQ ID NO: 4755 - RNA, 23 nt, Homo sapiens
uucugggcuguucucgcuucgga

SEQ ID NO: 4756 - RNA, 23 nt, Homo sapiens
ucugggcuguucucgcuucggag

SEQ ID NO: 4757 - RNA, 23 nt, Homo sapiens
cugggcuguucucgcuucggagg

SEQ ID NO: 4758 - RNA, 23 nt, Homo sapiens
gggcuguucucgcuucggaggag

SEQ ID NO: 4759 - RNA, 23 nt, Homo sapiens
gagccgcgagaagugcuagcucg

SEQ ID NO: 4760 - RNA, 23 nt, Homo sapiens
agccgcgagaagugcuagcucgg

SEQ ID NO: 4761 - RNA, 23 nt, Homo sapiens
gggccuccgaaaccaugaacuuu

SEQ ID NO: 4762 - RNA, 23 nt, Homo sapiens
agaaggaggagggcagaaucauc

SEQ ID NO: 4763 - RNA, 23 nt, Homo sapiens
agggcagaaucaucacgaagugg

SEQ ID NO: 4764 - RNA, 23 nt, Homo sapiens
agaaucaucacgaaguggugaag

SEQ ID NO: 4765 - RNA, 23 nt, Homo sapiens
gaaucaucacgaaguggugaagu

SEQ ID NO: 4766 - RNA, 23 nt, Homo sapiens
aaucaucacgaaguggugaaguu

SEQ ID NO: 4767 - RNA, 23 nt, Homo sapiens
aucaucacgaaguggugaaguuc

SEQ ID NO: 4768 - RNA, 23 nt, Homo sapiens
caucacgaaguggugaaguucau

SEQ ID NO: 4769 - RNA, 23 nt, Homo sapiens
cgaaguggugaaguucauggaug

SEQ ID NO: 4770 - RNA, 23 nt, Homo sapiens
gaaguggugaaguucauggaugu

SEQ ID NO: 4771 - RNA, 23 nt, Homo sapiens
aaguggugaaguucauggauguc

SEQ ID NO: 4772 - RNA, 23 nt, Homo sapiens
guggugaaguucauggaugucua

SEQ ID NO: 4773 - RNA, 23 nt, Homo sapiens
uggugaaguucauggaugucuau

SEQ ID NO: 4774 - RNA, 23 nt, Homo sapiens
ggugaaguucauggaugucuauc

SEQ ID NO: 4775 - RNA, 23 nt, Homo sapiens
ugaaguucauggaugucuaucag

SEQ ID NO: 4776 - RNA, 23 nt, Homo sapiens
gaaguucauggaugucuaucagc

SEQ ID NO: 4777 - RNA, 23 nt, Homo sapiens
aguucauggaugucuaucagcgc

SEQ ID NO: 4778 - RNA, 23 nt, Homo sapiens
ugguggacaucuuccaggaguac

SEQ ID NO: 4779 - RNA, 23 nt, Homo sapiens
gaucgaguacaucuucaagccau

SEQ ID NO: 4780 - RNA, 23 nt, Homo sapiens
aucgaguacaucuucaagccauc

SEQ ID NO: 4781 - RNA, 23 nt, Homo sapiens
ucgaguacaucuucaagccaucc

SEQ ID NO: 4782 - RNA, 23 nt, Homo sapiens
gaguacaucuucaagccauccug

SEQ ID NO: 4783 - RNA, 23 nt, Homo sapiens
guccaacaucaccaugcagauua

SEQ ID NO: 4784 - RNA, 23 nt, Homo sapiens
uccaacaucaccaugcagauuau

SEQ ID NO: 4785 - RNA, 23 nt, Homo sapiens
caacaucaccaugcagauuaugc

SEQ ID NO: 4786 - RNA, 23 nt, Homo sapiens
aacaucaccaugcagauuaugcg

SEQ ID NO: 4787 - RNA, 23 nt, Homo sapiens
ucaccaugcagauuaugcggauc

SEQ ID NO: 4788 - RNA, 23 nt, Homo sapiens
ccaugcagauuaugcggaucaaa

SEQ ID NO: 4789 - RNA, 23 nt, Homo sapiens
caugcagauuaugcggaucaaac

SEQ ID NO: 4790 - RNA, 23 nt, Homo sapiens
augcagauuaugcggaucaaacc

SEQ ID NO: 4791 - RNA, 23 nt, Homo sapiens
cagauuaugcggaucaaaccuca

SEQ ID NO: 4792 - RNA, 23 nt, Homo sapiens
agauuaugcggaucaaaccucac

SEQ ID NO: 4793 - RNA, 23 nt, Homo sapiens
ugcggaucaaaccucaccaaggc

SEQ ID NO: 4794 - RNA, 23 nt, Homo sapiens
uaggagagaugagcuuccuacag

SEQ ID NO: 4795 - RNA, 23 nt, Homo sapiens
gagagaugagcuuccuacagcac

SEQ ID NO: 4796 - RNA, 23 nt, Homo sapiens
gagaugagcuuccuacagcacaa

SEQ ID NO: 4797 - RNA, 23 nt, Homo sapiens
agaugagcuuccuacagcacaac

SEQ ID NO: 4798 - RNA, 23 nt, Homo sapiens
augagcuuccuacagcacaacaa

SEQ ID NO: 4799 - RNA, 23 nt, Homo sapiens
ugagcuuccuacagcacaacaaa

SEQ ID NO: 4800 - RNA, 23 nt, Homo sapiens
gagcuuccuacagcacaacaaau

SEQ ID NO: 4801 - RNA, 23 nt, Homo sapiens
agcuuccuacagcacaacaaaug

SEQ ID NO: 4802 - RNA, 23 nt, Homo sapiens
cuuccuacagcacaacaaaugug

SEQ ID NO: 4803 - RNA, 23 nt, Homo sapiens
uccuacagcacaacaaaugugaa

SEQ ID NO: 4804 - RNA, 23 nt, Homo sapiens
ccuacagcacaacaaaugugaau

SEQ ID NO: 4805 - RNA, 23 nt, Homo sapiens
acagcacaacaaaugugaaugca

SEQ ID NO: 4806 - RNA, 23 nt, Homo sapiens
cagcacaacaaaugugaaugcag

SEQ ID NO: 4807 - RNA, 23 nt, Homo sapiens
cucucaccaggaaagacugauac

SEQ ID NO: 4808 - RNA, 23 nt, Homo sapiens
ucucaccaggaaagacugauaca

SEQ ID NO: 4809 - RNA, 23 nt, Homo sapiens
cucaccaggaaagacugauacag

SEQ ID NO: 4810 - RNA, 23 nt, Homo sapiens
ucaccaggaaagacugauacaga

SEQ ID NO: 4811 - RNA, 23 nt, Homo sapiens
caccaggaaagacugauacagaa

SEQ ID NO: 4812 - RNA, 23 nt, Homo sapiens
accaggaaagacugauacagaac

SEQ ID NO: 4813 - RNA, 23 nt, Homo sapiens
ccaggaaagacugauacagaacg

SEQ ID NO: 4814 - RNA, 23 nt, Homo sapiens
caggaaagacugauacagaacga

SEQ ID NO: 4815 - RNA, 23 nt, Homo sapiens
aggaaagacugauacagaacgau

SEQ ID NO: 4816 - RNA, 23 nt, Homo sapiens
ggaaagacugauacagaacgauc

SEQ ID NO: 4817 - RNA, 23 nt, Homo sapiens
gaaagacugauacagaacgaucg

SEQ ID NO: 4818 - RNA, 23 nt, Homo sapiens
aaagacugauacagaacgaucga

SEQ ID NO: 4819 - RNA, 23 nt, Homo sapiens
aagacugauacagaacgaucgau

SEQ ID NO: 4820 - RNA, 23 nt, Homo sapiens
agacugauacagaacgaucgaua

SEQ ID NO: 4821 - RNA, 23 nt, Homo sapiens
gacugauacagaacgaucgauac

SEQ ID NO: 4822 - RNA, 23 nt, Homo sapiens
acugauacagaacgaucgauaca

SEQ ID NO: 4823 - RNA, 23 nt, Homo sapiens
cugauacagaacgaucgauacag

SEQ ID NO: 4824 - RNA, 23 nt, Homo sapiens
ugauacagaacgaucgauacaga

SEQ ID NO: 4825 - RNA, 23 nt, Homo sapiens
gauacagaacgaucgauacagaa

SEQ ID NO: 4826 - RNA, 23 nt, Homo sapiens
auacagaacgaucgauacagaaa

SEQ ID NO: 4827 - RNA, 23 nt, Homo sapiens
uacagaacgaucgauacagaaac

SEQ ID NO: 4828 - RNA, 23 nt, Homo sapiens
acagaacgaucgauacagaaacc

SEQ ID NO: 4829 - RNA, 23 nt, Homo sapiens
cagaacgaucgauacagaaacca

SEQ ID NO: 4830 - RNA, 23 nt, Homo sapiens
agaacgaucgauacagaaaccac

SEQ ID NO: 4831 - RNA, 23 nt, Homo sapiens
gaacgaucgauacagaaaccacg

SEQ ID NO: 4832 - RNA, 23 nt, Homo sapiens
aacgaucgauacagaaaccacgc

SEQ ID NO: 4833 - RNA, 23 nt, Homo sapiens
cacaccaucaccaucgacagaac

SEQ ID NO: 4834 - RNA, 23 nt, Homo sapiens
accaucaccaucgacagaacagu

SEQ ID NO: 4835 - RNA, 23 nt, Homo sapiens
caucaccaucgacagaacagucc

SEQ ID NO: 4836 - RNA, 23 nt, Homo sapiens
aucaccaucgacagaacaguccu

SEQ ID NO: 4837 - RNA, 23 nt, Homo sapiens
ucaccaucgacagaacaguccuu

SEQ ID NO: 4838 - RNA, 23 nt, Homo sapiens
caccaucgacagaacaguccuua

SEQ ID NO: 4839 - RNA, 23 nt, Homo sapiens
accaucgacagaacaguccuuaa

SEQ ID NO: 4840 - RNA, 23 nt, Homo sapiens
ccaucgacagaacaguccuuaau

SEQ ID NO: 4841 - RNA, 23 nt, Homo sapiens
caucgacagaacaguccuuaauc

SEQ ID NO: 4842 - RNA, 23 nt, Homo sapiens
aucgacagaacaguccuuaaucc

SEQ ID NO: 4843 - RNA, 23 nt, Homo sapiens
ucgacagaacaguccuuaaucca

SEQ ID NO: 4844 - RNA, 23 nt, Homo sapiens
cgacagaacaguccuuaauccag

SEQ ID NO: 4845 - RNA, 23 nt, Homo sapiens
acagaacaguccuuaauccagaa

SEQ ID NO: 4846 - RNA, 23 nt, Homo sapiens
cagaacaguccuuaauccagaaa

SEQ ID NO: 4847 - RNA, 23 nt, Homo sapiens
agaacaguccuuaauccagaaac

SEQ ID NO: 4848 - RNA, 23 nt, Homo sapiens
gaacaguccuuaauccagaaacc

SEQ ID NO: 4849 - RNA, 23 nt, Homo sapiens
aacaguccuuaauccagaaaccu

SEQ ID NO: 4850 - RNA, 23 nt, Homo sapiens
acaguccuuaauccagaaaccug

SEQ ID NO: 4851 - RNA, 23 nt, Homo sapiens
caguccuuaauccagaaaccuga

SEQ ID NO: 4852 - RNA, 23 nt, Homo sapiens
aguccuuaauccagaaaccugaa

SEQ ID NO: 4853 - RNA, 23 nt, Homo sapiens
guccuuaauccagaaaccugaaa

SEQ ID NO: 4854 - RNA, 23 nt, Homo sapiens
uccuuaauccagaaaccugaaau

SEQ ID NO: 4855 - RNA, 23 nt, Homo sapiens
ccuuaauccagaaaccugaaaug

SEQ ID NO: 4856 - RNA, 23 nt, Homo sapiens
uccagaaaccugaaaugaaggaa

SEQ ID NO: 4857 - RNA, 23 nt, Homo sapiens
ccagaaaccugaaaugaaggaag

SEQ ID NO: 4858 - RNA, 23 nt, Homo sapiens
cagaaaccugaaaugaaggaaga

SEQ ID NO: 4859 - RNA, 23 nt, Homo sapiens
agaaaccugaaaugaaggaagag

SEQ ID NO: 4860 - RNA, 23 nt, Homo sapiens
gaaaccugaaaugaaggaagagg

SEQ ID NO: 4861 - RNA, 23 nt, Homo sapiens
aaccugaaaugaaggaagaggag

SEQ ID NO: 4862 - RNA, 23 nt, Homo sapiens
aaaugaaggaagaggagacucug

SEQ ID NO: 4863 - RNA, 23 nt, Homo sapiens
ggucccucuuggaauuggauucg

SEQ ID NO: 4864 - RNA, 23 nt, Homo sapiens
ucccucuuggaauuggauucgcc

SEQ ID NO: 4865 - RNA, 23 nt, Homo sapiens
cccucuuggaauuggauucgcca

SEQ ID NO: 4866 - RNA, 23 nt, Homo sapiens
ucuuggaauuggauucgccauuu

SEQ ID NO: 4867 - RNA, 23 nt, Homo sapiens
cuuggaauuggauucgccauuuu

SEQ ID NO: 4868 - RNA, 23 nt, Homo sapiens
uuggaauuggauucgccauuuua

SEQ ID NO: 4869 - RNA, 23 nt, Homo sapiens
uggaauuggauucgccauuuuau

SEQ ID NO: 4870 - RNA, 23 nt, Homo sapiens
ggaauuggauucgccauuuuauu

SEQ ID NO: 4871 - RNA, 23 nt, Homo sapiens
gaauuggauucgccauuuuauuu

SEQ ID NO: 4872 - RNA, 23 nt, Homo sapiens
aauuggauucgccauuuuauuuu

SEQ ID NO: 4873 - RNA, 23 nt, Homo sapiens
auuggauucgccauuuuauuuuu

SEQ ID NO: 4874 - RNA, 23 nt, Homo sapiens
uuggauucgccauuuuauuuuuc

SEQ ID NO: 4875 - RNA, 23 nt, Homo sapiens
uggauucgccauuuuauuuuucu

SEQ ID NO: 4876 - RNA, 23 nt, Homo sapiens
auucgccauuuuauuuuucuugc

SEQ ID NO: 4877 - RNA, 23 nt, Homo sapiens
uucgccauuuuauuuuucuugcu

SEQ ID NO: 4878 - RNA, 23 nt, Homo sapiens
ucgccauuuuauuuuucuugcug

SEQ ID NO: 4879 - RNA, 23 nt, Homo sapiens
cgccauuuuauuuuucuugcugc

SEQ ID NO: 4880 - RNA, 23 nt, Homo sapiens
gccauuuuauuuuucuugcugcu

SEQ ID NO: 4881 - RNA, 23 nt, Homo sapiens
ccauuuuauuuuucuugcugcua

SEQ ID NO: 4882 - RNA, 23 nt, Homo sapiens
cauuuuauuuuucuugcugcuaa

SEQ ID NO: 4883 - RNA, 23 nt, Homo sapiens
uuuuucuugcugcuaaaucaccg

SEQ ID NO: 4884 - RNA, 23 nt, Homo sapiens
aaucaccgagcccggaagauuag

SEQ ID NO: 4885 - RNA, 23 nt, Homo sapiens
gagcccggaagauuagagaguuu

SEQ ID NO: 4886 - RNA, 23 nt, Homo sapiens
agcccggaagauuagagaguuuu

SEQ ID NO: 4887 - RNA, 23 nt, Homo sapiens
cccggaagauuagagaguuuuau

SEQ ID NO: 4888 - RNA, 23 nt, Homo sapiens
ccggaagauuagagaguuuuauu

SEQ ID NO: 4889 - RNA, 23 nt, Homo sapiens
cggaagauuagagaguuuuauuu

SEQ ID NO: 4890 - RNA, 23 nt, Homo sapiens
ggaagauuagagaguuuuauuuc

SEQ ID NO: 4891 - RNA, 23 nt, Homo sapiens
gaagauuagagaguuuuauuucu

SEQ ID NO: 4892 - RNA, 23 nt, Homo sapiens
agauuagagaguuuuauuucugg

SEQ ID NO: 4893 - RNA, 23 nt, Homo sapiens
gauuagagaguuuuauuucuggg

SEQ ID NO: 4894 - RNA, 23 nt, Homo sapiens
auuagagaguuuuauuucuggga

SEQ ID NO: 4895 - RNA, 23 nt, Homo sapiens
uuagagaguuuuauuucugggau

SEQ ID NO: 4896 - RNA, 23 nt, Homo sapiens
uagagaguuuuauuucugggauu

SEQ ID NO: 4897 - RNA, 23 nt, Homo sapiens
agagaguuuuauuucugggauuc

SEQ ID NO: 4898 - RNA, 23 nt, Homo sapiens
gagaguuuuauuucugggauucc

SEQ ID NO: 4899 - RNA, 23 nt, Homo sapiens
agaguuuuauuucugggauuccu

SEQ ID NO: 4900 - RNA, 23 nt, Homo sapiens
gaguuuuauuucugggauuccug

SEQ ID NO: 4901 - RNA, 23 nt, Homo sapiens
aguuuuauuucugggauuccugu

SEQ ID NO: 4902 - RNA, 23 nt, Homo sapiens
guuuuauuucugggauuccugua

SEQ ID NO: 4903 - RNA, 23 nt, Homo sapiens
uuuuauuucugggauuccuguag

SEQ ID NO: 4904 - RNA, 23 nt, Homo sapiens
uuuauuucugggauuccuguaga

SEQ ID NO: 4905 - RNA, 23 nt, Homo sapiens
uuauuucugggauuccuguagac

SEQ ID NO: 4906 - RNA, 23 nt, Homo sapiens
uauuucugggauuccuguagaca

SEQ ID NO: 4907 - RNA, 23 nt, Homo sapiens
uuucugggauuccuguagacaca

SEQ ID NO: 4908 - RNA, 23 nt, Homo sapiens
uucugggauuccuguagacacac

SEQ ID NO: 4909 - RNA, 23 nt, Homo sapiens
ucugggauuccuguagacacacc

SEQ ID NO: 4910 - RNA, 23 nt, Homo sapiens
cugggauuccuguagacacaccc

SEQ ID NO: 4911 - RNA, 23 nt, Homo sapiens
agacacacccacccacauacaua

SEQ ID NO: 4912 - RNA, 23 nt, Homo sapiens
acacccacccacauacauacauu

SEQ ID NO: 4913 - RNA, 23 nt, Homo sapiens
cacccacccacauacauacauuu

SEQ ID NO: 4914 - RNA, 23 nt, Homo sapiens
acccacccacauacauacauuua

SEQ ID NO: 4915 - RNA, 23 nt, Homo sapiens
cccacccacauacauacauuuau

SEQ ID NO: 4916 - RNA, 23 nt, Homo sapiens
acccacauacauacauuuauaua

SEQ ID NO: 4917 - RNA, 23 nt, Homo sapiens
cccacauacauacauuuauauau

SEQ ID NO: 4918 - RNA, 23 nt, Homo sapiens
uuuuaaauuaacagugcuaaugu

SEQ ID NO: 4919 - RNA, 23 nt, Homo sapiens
uuuaaauuaacagugcuaauguu

SEQ ID NO: 4920 - RNA, 23 nt, Homo sapiens
uuaaauuaacagugcuaauguua

SEQ ID NO: 4921 - RNA, 23 nt, Homo sapiens
uaaauuaacagugcuaauguuau

SEQ ID NO: 4922 - RNA, 23 nt, Homo sapiens
aaauuaacagugcuaauguuauu

SEQ ID NO: 4923 - RNA, 23 nt, Homo sapiens
aauuaacagugcuaauguuauug

SEQ ID NO: 4924 - RNA, 23 nt, Homo sapiens
auuaacagugcuaauguuauugg

SEQ ID NO: 4925 - RNA, 23 nt, Homo sapiens
uuaacagugcuaauguuauuggu

SEQ ID NO: 4926 - RNA, 23 nt, Homo sapiens
uaacagugcuaauguuauuggug

SEQ ID NO: 4927 - RNA, 23 nt, Homo sapiens
aacagugcuaauguuauuggugu

SEQ ID NO: 4928 - RNA, 23 nt, Homo sapiens
cagugcuaauguuauuggugucu

SEQ ID NO: 4929 - RNA, 23 nt, Homo sapiens
agugcuaauguuauuggugucuu

SEQ ID NO: 4930 - RNA, 23 nt, Homo sapiens
gugcuaauguuauuggugucuuc

SEQ ID NO: 4931 - RNA, 23 nt, Homo sapiens
ugcuaauguuauuggugucuuca

SEQ ID NO: 4932 - RNA, 23 nt, Homo sapiens
gcuaauguuauuggugucuucac

SEQ ID NO: 4933 - RNA, 23 nt, Homo sapiens
cuaauguuauuggugucuucacu

SEQ ID NO: 4934 - RNA, 23 nt, Homo sapiens
uaauguuauuggugucuucacug

SEQ ID NO: 4935 - RNA, 23 nt, Homo sapiens
aauguuauuggugucuucacugg

SEQ ID NO: 4936 - RNA, 23 nt, Homo sapiens
auguuauuggugucuucacugga

SEQ ID NO: 4937 - RNA, 23 nt, Homo sapiens
uguuauuggugucuucacuggau

SEQ ID NO: 4938 - RNA, 23 nt, Homo sapiens
auuggugucuucacuggauguau

SEQ ID NO: 4939 - RNA, 23 nt, Homo sapiens
ggugucuucacuggauguauuug

SEQ ID NO: 4940 - RNA, 23 nt, Homo sapiens
uucacuggauguauuugacugcu

SEQ ID NO: 4941 - RNA, 23 nt, Homo sapiens
ucacuggauguauuugacugcug

SEQ ID NO: 4942 - RNA, 23 nt, Homo sapiens
acuggauguauuugacugcugug

SEQ ID NO: 4943 - RNA, 23 nt, Homo sapiens
uguauuugacugcuguggacuug

SEQ ID NO: 4944 - RNA, 23 nt, Homo sapiens
uauuugacugcuguggacuugag

SEQ ID NO: 4945 - RNA, 23 nt, Homo sapiens
cugcuguggacuugaguugggag

SEQ ID NO: 4946 - RNA, 23 nt, Homo sapiens
guucccacucagauccugacagg

SEQ ID NO: 4947 - RNA, 23 nt, Homo sapiens
uucccacucagauccugacaggg

SEQ ID NO: 4948 - RNA, 23 nt, Homo sapiens
gaggaggagaugagagacucugg

SEQ ID NO: 4949 - RNA, 23 nt, Homo sapiens
aggaggagaugagagacucuggc

SEQ ID NO: 4950 - RNA, 23 nt, Homo sapiens
gaggagaugagagacucuggcau

SEQ ID NO: 4951 - RNA, 23 nt, Homo sapiens
gagagacucuggcaugaucuuuu

SEQ ID NO: 4952 - RNA, 23 nt, Homo sapiens
agagacucuggcaugaucuuuuu

SEQ ID NO: 4953 - RNA, 23 nt, Homo sapiens
aguuuugggaacaccgacaaacc

SEQ ID NO: 4954 - RNA, 23 nt, Homo sapiens
gggagcuucaggacauugcugug

SEQ ID NO: 4955 - RNA, 23 nt, Homo sapiens
gagcuucaggacauugcugugcu

SEQ ID NO: 4956 - RNA, 23 nt, Homo sapiens
agcuucaggacauugcugugcuu

SEQ ID NO: 4957 - RNA, 23 nt, Homo sapiens
gcuucaggacauugcugugcuuu

SEQ ID NO: 4958 - RNA, 23 nt, Homo sapiens
cuucaggacauugcugugcuuug

SEQ ID NO: 4959 - RNA, 23 nt, Homo sapiens
uucaggacauugcugugcuuugg

SEQ ID NO: 4960 - RNA, 23 nt, Homo sapiens
uucgcuuacucucaccugcuucu

SEQ ID NO: 4961 - RNA, 23 nt, Homo sapiens
ucgcuuacucucaccugcuucug

SEQ ID NO: 4962 - RNA, 23 nt, Homo sapiens
gcuuacucucaccugcuucugag

SEQ ID NO: 4963 - RNA, 23 nt, Homo sapiens
uacucucaccugcuucugaguug

SEQ ID NO: 4964 - RNA, 23 nt, Homo sapiens
acucucaccugcuucugaguugc

SEQ ID NO: 4965 - RNA, 23 nt, Homo sapiens
cucucaccugcuucugaguugcc

SEQ ID NO: 4966 - RNA, 23 nt, Homo sapiens
ucucaccugcuucugaguugccc

SEQ ID NO: 4967 - RNA, 23 nt, Homo sapiens
cucaccugcuucugaguugccca

SEQ ID NO: 4968 - RNA, 23 nt, Homo sapiens
ucaccugcuucugaguugcccag

SEQ ID NO: 4969 - RNA, 23 nt, Homo sapiens
caccugcuucugaguugcccagg

SEQ ID NO: 4970 - RNA, 23 nt, Homo sapiens
cccggcgaagagaagagacacau

SEQ ID NO: 4971 - RNA, 23 nt, Homo sapiens
ccggcgaagagaagagacacauu

SEQ ID NO: 4972 - RNA, 23 nt, Homo sapiens
cggcgaagagaagagacacauug

SEQ ID NO: 4973 - RNA, 23 nt, Homo sapiens
ggcgaagagaagagacacauugu

SEQ ID NO: 4974 - RNA, 23 nt, Homo sapiens
gcgaagagaagagacacauuguu

SEQ ID NO: 4975 - RNA, 23 nt, Homo sapiens
cgaagagaagagacacauuguug

SEQ ID NO: 4976 - RNA, 23 nt, Homo sapiens
gaagagaagagacacauuguugg

SEQ ID NO: 4977 - RNA, 23 nt, Homo sapiens
aagagaagagacacauuguugga

SEQ ID NO: 4978 - RNA, 23 nt, Homo sapiens
agagaagagacacauuguuggaa

SEQ ID NO: 4979 - RNA, 23 nt, Homo sapiens
gagaagagacacauuguuggaag

SEQ ID NO: 4980 - RNA, 23 nt, Homo sapiens
agaagagacacauuguuggaaga

SEQ ID NO: 4981 - RNA, 23 nt, Homo sapiens
gaagagacacauuguuggaagaa

SEQ ID NO: 4982 - RNA, 23 nt, Homo sapiens
aagagacacauuguuggaagaag

SEQ ID NO: 4983 - RNA, 23 nt, Homo sapiens
agagacacauuguuggaagaagc

SEQ ID NO: 4984 - RNA, 23 nt, Homo sapiens
gagacacauuguuggaagaagca

SEQ ID NO: 4985 - RNA, 23 nt, Homo sapiens
agacacauuguuggaagaagcag

SEQ ID NO: 4986 - RNA, 23 nt, Homo sapiens
gacacauuguuggaagaagcagc

SEQ ID NO: 4987 - RNA, 23 nt, Homo sapiens
ccuauguccucacaccauugaaa

SEQ ID NO: 4988 - RNA, 23 nt, Homo sapiens
uguccucacaccauugaaaccac

SEQ ID NO: 4989 - RNA, 23 nt, Homo sapiens
guccucacaccauugaaaccacu

SEQ ID NO: 4990 - RNA, 23 nt, Homo sapiens
uccucacaccauugaaaccacua

SEQ ID NO: 4991 - RNA, 23 nt, Homo sapiens
ccucacaccauugaaaccacuag

SEQ ID NO: 4992 - RNA, 23 nt, Homo sapiens
cucacaccauugaaaccacuagu

SEQ ID NO: 4993 - RNA, 23 nt, Homo sapiens
caccauugaaaccacuaguucug

SEQ ID NO: 4994 - RNA, 23 nt, Homo sapiens
accauugaaaccacuaguucugu

SEQ ID NO: 4995 - RNA, 23 nt, Homo sapiens
ccauugaaaccacuaguucuguc

SEQ ID NO: 4996 - RNA, 23 nt, Homo sapiens
cauugaaaccacuaguucugucc

SEQ ID NO: 4997 - RNA, 23 nt, Homo sapiens
auugaaaccacuaguucuguccc

SEQ ID NO: 4998 - RNA, 23 nt, Homo sapiens
gagaccugguuguguguguguga

SEQ ID NO: 4999 - RNA, 23 nt, Homo sapiens
agaccugguugugugugugugag

SEQ ID NO: 5000 - RNA, 23 nt, Homo sapiens
gaccugguugugugugugugagu

SEQ ID NO: 5001 - RNA, 23 nt, Homo sapiens
accugguugugugugugugagug

SEQ ID NO: 5002 - RNA, 23 nt, Homo sapiens
ccugguugugugugugugagugg

SEQ ID NO: 5003 - RNA, 21 nt, Artificial Sequence
  source: /note="Description of Artificial Sequence: Synthetic oligonucleotide"
aacaguguucuugcucuauaa

SEQ ID NO: 5004 - RNA, 23 nt, Artificial Sequence
  source: /note="Description of Artificial Sequence: Synthetic oligonucleotide"
uuauagagcaagaacacuguuuu

SEQ ID NO: 5005 - RNA, 21 nt, Artificial Sequence
  source: /note="Description of Artificial Sequence: Synthetic oligonucleotide"
augcagauuaugcggaucaaa

SEQ ID NO: 5006 - RNA, 21 nt, Artificial Sequence
  source: /note="Description of Artificial Sequence: Synthetic oligonucleotide"
accaggaaagacugauacaga

SEQ ID NO: 5007 - RNA, 21 nt, Artificial Sequence
  source: /note="Description of Artificial Sequence: Synthetic oligonucleotide"
agaacaguccuuaauccagaa

SEQ ID NO: 5008 - RNA, 21 nt, Artificial Sequence
  source: /note="Description of Artificial Sequence: Synthetic oligonucleotide"
agauuagagaguuuuauuuca

SEQ ID NO: 5009 - RNA, 21 nt, Artificial Sequence
  source: /note="Description of Artificial Sequence: Synthetic oligonucleotide"
aaaagagaaaguguuuuauaa

SEQ ID NO: 5010 - RNA, 21 nt, Artificial Sequence
  source: /note="Description of Artificial Sequence: Synthetic oligonucleotide"
aaagagaaaguguuuuauaua

SEQ ID NO: 5011 - RNA, 21 nt, Artificial Sequence
  source: /note="Description of Artificial Sequence: Synthetic oligonucleotide"
cuacagcacaacaaaugugaa

SEQ ID NO: 5012 - RNA, 21 nt, Artificial Sequence
  source: /note="Description of Artificial Sequence: Synthetic oligonucleotide"
aaagacugauacagaacgaua

SEQ ID NO: 5013 - RNA, 21 nt, Artificial Sequence
  source: /note="Description of Artificial Sequence: Synthetic oligonucleotide"
aagacugauacagaacgauca

SEQ ID NO: 5014 - RNA, 21 nt, Artificial Sequence
  source: /note="Description of Artificial Sequence: Synthetic oligonucleotide"
auacagaacgaucgauacaga

SEQ ID NO: 5015 - RNA, 21 nt, Artificial Sequence
  source: /note="Description of Artificial Sequence: Synthetic oligonucleotide"
cagaacaguccuuaauccaga

SEQ ID NO: 5016 - RNA, 21 nt, Artificial Sequence
  source: /note="Description of Artificial Sequence: Synthetic oligonucleotide"
auuggauucgccauuuuauua

SEQ ID NO: 5017 - RNA, 21 nt, Artificial Sequence
  source: /note="Description of Artificial Sequence: Synthetic oligonucleotide"
gauucgccauuuuauuuuuca

SEQ ID NO: 5018 - RNA, 21 nt, Artificial Sequence
  source: /note="Description of Artificial Sequence: Synthetic oligonucleotide"
gagaaaguguuuuauauacga

SEQ ID NO: 5019 - RNA, 21 nt, Artificial Sequence
  source: /note="Description of Artificial Sequence: Synthetic oligonucleotide"
guguuuuauauacgguacuua

SEQ ID NO: 5020 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauuagagaguuuuauuuca

SEQ ID NO: 5021 - RNA, 21 nt, Artificial Sequence
  source: /note="Description of Artificial Sequence: Synthetic oligonucleotide"
aacaguguucuugcucuauaa

SEQ ID NO: 5022 - RNA, 23 nt, Artificial Sequence
  source: /note="Description of Artificial Sequence: Synthetic oligonucleotide"
uuauagagcaagaacacuguuuu

SEQ ID NO: 5023 - RNA, 21 nt, Artificial Sequence
  source: /note="Description of Artificial Sequence: Synthetic oligonucleotide"
augcagauuaugcggaucaaa

SEQ ID NO: 5024 - RNA, 21 nt, Artificial Sequence
  source: /note="Description of Artificial Sequence: Synthetic oligonucleotide"
accaggaaagacugauacaga

SEQ ID NO: 5025 - RNA, 21 nt, Artificial Sequence
  source: /note="Description of Artificial Sequence: Synthetic oligonucleotide"
agaacaguccuuaauccagaa

SEQ ID NO: 5026 - RNA, 21 nt, Artificial Sequence
  source: /note="Description of Artificial Sequence: Synthetic oligonucleotide"
agauuagagaguuuuauuuca

SEQ ID NO: 5027 - RNA, 21 nt, Artificial Sequence
  source: /note="Description of Artificial Sequence: Synthetic oligonucleotide"
aaaagagaaaguguuuuauaa

SEQ ID NO: 5028 - RNA, 21 nt, Artificial Sequence
  source: /note="Description of Artificial Sequence: Synthetic oligonucleotide"
aaagagaaaguguuuuauaua

SEQ ID NO: 5029 - RNA, 21 nt, Artificial Sequence
  source: /note="Description of Artificial Sequence: Synthetic oligonucleotide"
cuacagcacaacaaaugugaa

SEQ ID NO: 5030 - RNA, 21 nt, Artificial Sequence
  source: /note="Description of Artificial Sequence: Synthetic oligonucleotide"
aaagacugauacagaacgaua

SEQ ID NO: 5031 - RNA, 21 nt, Artificial Sequence
  source: /note="Description of Artificial Sequence: Synthetic oligonucleotide"
aagacugauacagaacgauca

SEQ ID NO: 5032 - RNA, 21 nt, Artificial Sequence
  source: /note="Description of Artificial Sequence: Synthetic oligonucleotide"
auacagaacgaucgauacaga

SEQ ID NO: 5033 - RNA, 21 nt, Artificial Sequence
  source: /note="Description of Artificial Sequence: Synthetic oligonucleotide"
cagaacaguccuuaauccaga

SEQ ID NO: 5034 - RNA, 21 nt, Artificial Sequence
  source: /note="Description of Artificial Sequence: Synthetic oligonucleotide"
auuggauucgccauuuuauua

SEQ ID NO: 5035 - RNA, 21 nt, Artificial Sequence
  source: /note="Description of Artificial Sequence: Synthetic oligonucleotide"
gauucgccauuuuauuuuuca

SEQ ID NO: 5036 - RNA, 21 nt, Artificial Sequence
  source: /note="Description of Artificial Sequence: Synthetic oligonucleotide"
gagaaaguguuuuauauacga

SEQ ID NO: 5037 - RNA, 21 nt, Artificial Sequence
  source: /note="Description of Artificial Sequence: Synthetic oligonucleotide"
guguuuuauauacgguacuua

SEQ ID NO: 5038 - RNA, 21 nt, Artificial Sequence
  source: /note="Description of Artificial Sequence: Synthetic oligonucleotide"
agauuagagaguuuuauuuca

SEQ ID NO: 5039 - DNA, 23 bp, Artificial Sequence
  source: /note="Description of Artificial Sequence: Synthetic oligonucleotide"
ugaucguucugtaucagucuuuc

SEQ ID NO: 5040 - RNA, 23 nt, Homo sapiens
uuuuauauacgguacuuauuuaa

SEQ ID NO: 5041 - RNA, 23 nt, Homo sapiens
uuuauauacgguacuuauuuaau

SEQ ID NO: 5042 - RNA, 23 nt, Homo sapiens
cgguacuuauuuaauaucccuuu

SEQ ID NO: 5043 - RNA, 23 nt, Homo sapiens
gguacuuauuuaauaucccuuuu

SEQ ID NO: 5044 - RNA, 23 nt, Homo sapiens
auuuaugagauguaucuuuugcu

SEQ ID NO: 5045 - RNA, 23 nt, Homo sapiens
uuuaugagauguaucuuuugcuc

SEQ ID NO: 5046 - RNA, 23 nt, Homo sapiens
uuaugagauguaucuuuugcucu

SEQ ID NO: 5047 - RNA, 23 nt, Homo sapiens
uaugagauguaucuuuugcucuc

SEQ ID NO: 5048 - RNA, 23 nt, Homo sapiens
augagauguaucuuuugcucucu

SEQ ID NO: 5049 - RNA, 23 nt, Homo sapiens
ugagauguaucuuuugcucucuc

SEQ ID NO: 5050 - RNA, 23 nt, Homo sapiens
gagauguaucuuuugcucucucu

SEQ ID NO: 5051 - RNA, 23 nt, Homo sapiens
agauguaucuuuugcucucucuu

SEQ ID NO: 5052 - RNA, 23 nt, Homo sapiens
uugcucucucuugcucucuuauu

SEQ ID NO: 5053 - RNA, 23 nt, Homo sapiens
ugcucucucuugcucucuuauuu

SEQ ID NO: 5054 - RNA, 23 nt, Homo sapiens
gcucucucuugcucucuuauuug

SEQ ID NO: 5055 - RNA, 23 nt, Homo sapiens
cucucucuugcucucuuauuugu

SEQ ID NO: 5056 - RNA, 23 nt, Homo sapiens
ucucucuugcucucuuauuugua

SEQ ID NO: 5057 - RNA, 23 nt, Homo sapiens
cucucuugcucucuuauuuguac

SEQ ID NO: 5058 - RNA, 23 nt, Homo sapiens
ucucuugcucucuuauuuguacc

SEQ ID NO: 5059 - RNA, 23 nt, Homo sapiens
cucuugcucucuuauuuguaccg

SEQ ID NO: 5060 - RNA, 23 nt, Homo sapiens
ucuugcucucuuauuuguaccgg

SEQ ID NO: 5061 - RNA, 23 nt, Homo sapiens
cuugcucucuuauuuguaccggu

SEQ ID NO: 5062 - RNA, 23 nt, Homo sapiens
ugcucucuuauuuguaccgguuu

SEQ ID NO: 5063 - RNA, 23 nt, Homo sapiens
gcucucuuauuuguaccgguuuu

SEQ ID NO: 5064 - RNA, 23 nt, Homo sapiens
cucucuuauuuguaccgguuuuu

SEQ ID NO: 5065 - RNA, 23 nt, Homo sapiens
ucucuuauuuguaccgguuuuug

SEQ ID NO: 5066 - RNA, 23 nt, Homo sapiens
cucuuauuuguaccgguuuuugu

SEQ ID NO: 5067 - RNA, 23 nt, Homo sapiens
ucuuauuuguaccgguuuuugua

SEQ ID NO: 5068 - RNA, 23 nt, Homo sapiens
cuuauuuguaccgguuuuuguau

SEQ ID NO: 5069 - RNA, 23 nt, Homo sapiens
uuauuuguaccgguuuuuguaua

SEQ ID NO: 5070 - RNA, 23 nt, Homo sapiens
uauuuguaccgguuuuuguauau

SEQ ID NO: 5071 - RNA, 23 nt, Homo sapiens
auuuguaccgguuuuuguauaua

SEQ ID NO: 5072 - RNA, 23 nt, Homo sapiens
uuuguaccgguuuuuguauauaa

SEQ ID NO: 5073 - RNA, 23 nt, Homo sapiens
uuguaccgguuuuuguauauaaa

SEQ ID NO: 5074 - RNA, 23 nt, Homo sapiens
uguaccgguuuuuguauauaaaa

SEQ ID NO: 5075 - RNA, 23 nt, Homo sapiens
guaccgguuuuuguauauaaaau

SEQ ID NO: 5076 - RNA, 23 nt, Homo sapiens
aaauucauguuuccaaucucucu

SEQ ID NO: 5077 - RNA, 23 nt, Homo sapiens
aauucauguuuccaaucucucuc

SEQ ID NO: 5078 - RNA, 23 nt, Homo sapiens
auucauguuuccaaucucucucu

SEQ ID NO: 5079 - RNA, 23 nt, Homo sapiens
uucauguuuccaaucucucucuc

SEQ ID NO: 5080 - RNA, 23 nt, Homo sapiens
ucauguuuccaaucucucucucc

SEQ ID NO: 5081 - RNA, 23 nt, Homo sapiens
cauguuuccaaucucucucuccc

SEQ ID NO: 5082 - RNA, 23 nt, Homo sapiens
uguuuccaaucucucucucccug

SEQ ID NO: 5083 - RNA, 23 nt, Homo sapiens
uuuccaaucucucucucccugau

SEQ ID NO: 5084 - RNA, 23 nt, Homo sapiens
aucggugacagucacuagcuuau

SEQ ID NO: 5085 - RNA, 23 nt, Homo sapiens
ucggugacagucacuagcuuauc

SEQ ID NO: 5086 - RNA, 23 nt, Homo sapiens
acagucacuagcuuaucuugaac

SEQ ID NO: 5087 - RNA, 23 nt, Homo sapiens
cagucacuagcuuaucuugaaca

SEQ ID NO: 5088 - RNA, 23 nt, Homo sapiens
agucacuagcuuaucuugaacag

SEQ ID NO: 5089 - RNA, 23 nt, Homo sapiens
ucacuagcuuaucuugaacagau

SEQ ID NO: 5090 - RNA, 23 nt, Homo sapiens
cacuagcuuaucuugaacagaua

SEQ ID NO: 5091 - RNA, 23 nt, Homo sapiens
acuagcuuaucuugaacagauau

SEQ ID NO: 5092 - RNA, 23 nt, Homo sapiens
cuagcuuaucuugaacagauauu

SEQ ID NO: 5093 - RNA, 23 nt, Homo sapiens
uagcuuaucuugaacagauauuu

SEQ ID NO: 5094 - RNA, 23 nt, Homo sapiens
cccagcacacauuccuuugaaau

SEQ ID NO: 5095 - RNA, 23 nt, Homo sapiens
ccagcacacauuccuuugaaaua

SEQ ID NO: 5096 - RNA, 23 nt, Homo sapiens
cagcacacauuccuuugaaauaa

SEQ ID NO: 5097 - RNA, 23 nt, Homo sapiens
agcacacauuccuuugaaauaag

SEQ ID NO: 5098 - RNA, 23 nt, Homo sapiens
cacacauuccuuugaaauaaggu

SEQ ID NO: 5099 - RNA, 23 nt, Homo sapiens
auuccuuugaaauaagguuucaa

SEQ ID NO: 5100 - RNA, 23 nt, Homo sapiens
uccuuugaaauaagguuucaaua

SEQ ID NO: 5101 - RNA, 23 nt, Homo sapiens
ccuuugaaauaagguuucaauau

SEQ ID NO: 5102 - RNA, 23 nt, Homo sapiens
uaagguuucaauauacaucuaca

SEQ ID NO: 5103 - RNA, 23 nt, Homo sapiens
aagguuucaauauacaucuacau

SEQ ID NO: 5104 - RNA, 23 nt, Homo sapiens
agguuucaauauacaucuacaua

SEQ ID NO: 5105 - RNA, 23 nt, Homo sapiens
gguuucaauauacaucuacauac

SEQ ID NO: 5106 - RNA, 23 nt, Homo sapiens
guuucaauauacaucuacauacu

SEQ ID NO: 5107 - RNA, 23 nt, Homo sapiens
uauauuuggcaacuuguauuugu

SEQ ID NO: 5108 - RNA, 23 nt, Homo sapiens
uauuuggcaacuuguauuugugu

SEQ ID NO: 5109 - RNA, 23 nt, Homo sapiens
uuuggcaacuuguauuugugugu

SEQ ID NO: 5110 - RNA, 23 nt, Homo sapiens
uuggcaacuuguauuugugugua

SEQ ID NO: 5111 - RNA, 23 nt, Homo sapiens
uggcaacuuguauuuguguguau

SEQ ID NO: 5112 - RNA, 23 nt, Homo sapiens
ggcaacuuguauuuguguguaua

SEQ ID NO: 5113 - RNA, 23 nt, Homo sapiens
gcaacuuguauuuguguguauau

SEQ ID NO: 5114 - RNA, 23 nt, Homo sapiens
caacuuguauuuguguguauaua

SEQ ID NO: 5115 - RNA, 23 nt, Homo sapiens
gauucugauaaaauagacauugc

SEQ ID NO: 5116 - RNA, 23 nt, Homo sapiens
ucugauaaaauagacauugcuau

SEQ ID NO: 5117 - RNA, 23 nt, Homo sapiens
cugauaaaauagacauugcuauu

SEQ ID NO: 5118 - RNA, 23 nt, Homo sapiens
gauaaaauagacauugcuauucu

SEQ ID NO: 5119 - RNA, 23 nt, Homo sapiens
aauagacauugcuauucuguuuu

SEQ ID NO: 5120 - RNA, 23 nt, Homo sapiens
auagacauugcuauucuguuuuu

SEQ ID NO: 5121 - RNA, 23 nt, Homo sapiens
auucuacauacuaaaucucucuc

SEQ ID NO: 5122 - RNA, 23 nt, Homo sapiens
uucuacauacuaaaucucucucc

SEQ ID NO: 5123 - RNA, 23 nt, Homo sapiens
ucuacauacuaaaucucucuccu

SEQ ID NO: 5124 - RNA, 23 nt, Homo sapiens
cuacauacuaaaucucucuccuu

SEQ ID NO: 5125 - RNA, 23 nt, Homo sapiens
uacauacuaaaucucucuccuuu

SEQ ID NO: 5126 - RNA, 23 nt, Homo sapiens
acauacuaaaucucucuccuuuu

SEQ ID NO: 5127 - RNA, 23 nt, Homo sapiens
cauacuaaaucucucuccuuuuu

SEQ ID NO: 5128 - RNA, 23 nt, Homo sapiens
aucauuuauuuauuggugcuacu

SEQ ID NO: 5129 - RNA, 23 nt, Homo sapiens
ucauuuauuuauuggugcuacug

SEQ ID NO: 5130 - RNA, 23 nt, Homo sapiens
cauuuauuuauuggugcuacugu

SEQ ID NO: 5131 - RNA, 23 nt, Homo sapiens
auuuauuuauuggugcuacuguu

SEQ ID NO: 5132 - RNA, 23 nt, Homo sapiens
uuuauuuauuggugcuacuguuu

SEQ ID NO: 5133 - RNA, 23 nt, Homo sapiens
uuauuuauuggugcuacuguuua

SEQ ID NO: 5134 - RNA, 23 nt, Homo sapiens
auuuauuggugcuacuguuuauc

SEQ ID NO: 5135 - RNA, 23 nt, Homo sapiens
uuauuggugcuacuguuuauccg

SEQ ID NO: 5136 - RNA, 23 nt, Homo sapiens
gggaaaagauauuaacaucacgu

SEQ ID NO: 5137 - RNA, 23 nt, Homo sapiens
uuaacaucacgucuuugucucua

SEQ ID NO: 5138 - RNA, 23 nt, Homo sapiens
uaacaucacgucuuugucucuag

SEQ ID NO: 5139 - RNA, 23 nt, Homo sapiens
acgucuuugucucuagugcaguu

SEQ ID NO: 5140 - RNA, 23 nt, Homo sapiens
cgucuuugucucuagugcaguuu

SEQ ID NO: 5141 - RNA, 23 nt, Homo sapiens
gucuuugucucuagugcaguuuu

SEQ ID NO: 5142 - RNA, 23 nt, Homo sapiens
ucgagauauuccguaguacauau

SEQ ID NO: 5143 - RNA, 23 nt, Homo sapiens
cgagauauuccguaguacauauu

SEQ ID NO: 5144 - RNA, 23 nt, Homo sapiens
gagauauuccguaguacauauuu

SEQ ID NO: 5145 - RNA, 23 nt, Homo sapiens
aacgacaaagaaauacagauaua

SEQ ID NO: 5146 - RNA, 23 nt, Homo sapiens
acgacaaagaaauacagauauau

SEQ ID NO: 5147 - RNA, 23 nt, Homo sapiens
cgacaaagaaauacagauauauc

SEQ ID NO: 5148 - RNA, 23 nt, Homo sapiens
gacaaagaaauacagauauaucu

SEQ ID NO: 5149 - RNA, 23 nt, Homo sapiens
agaaaagagaaaguguuuuauau

SEQ ID NO: 5150 - RNA, 23 nt, Homo sapiens
agaaaagagaaaguguuuuauau

SEQ ID NO: 5151 - RNA, 23 nt, Homo sapiens
agaaaagagaaaguguuuuauau

SEQ ID NO: 5152 - RNA, 23 nt, Homo sapiens
ggaaagacugauacagaacgauc

SEQ ID NO: 5153 - RNA, 23 nt, Homo sapiens
ggaaagacugauacagaacgauc

SEQ ID NO: 5154 - RNA, 23 nt, Homo sapiens
ggaaagacugauacagaacgauc

SEQ ID NO: 5155 - RNA, 23 nt, Homo sapiens
gaaaagagaaaguguuuuauaua

SEQ ID NO: 5156 - RNA, 23 nt, Homo sapiens
gaaaagagaaaguguuuuauaua

SEQ ID NO: 5157 - RNA, 23 nt, Homo sapiens
gaaaagagaaaguguuuuauaua

SEQ ID NO: 5158 - RNA, 23 nt, Homo sapiens
uuaacagugcuaauguuauuggu

SEQ ID NO: 5159 - RNA, 23 nt, Homo sapiens
uuaacagugcuaauguuauuggu

SEQ ID NO: 5160 - RNA, 23 nt, Homo sapiens
uuaacagugcuaauguuauuggu

SEQ ID NO: 5161 - RNA, 23 nt, Homo sapiens
agaacgaucgauacagaaaccac

SEQ ID NO: 5162 - RNA, 23 nt, Homo sapiens
agaacgaucgauacagaaaccac

SEQ ID NO: 5163 - RNA, 23 nt, Homo sapiens
agaacgaucgauacagaaaccac

SEQ ID NO: 5164 - RNA, 23 nt, Homo sapiens
gaaagacugauacagaacgaucg

SEQ ID NO: 5165 - RNA, 23 nt, Homo sapiens
gaaagacugauacagaacgaucg

SEQ ID NO: 5166 - RNA, 23 nt, Homo sapiens
gaaagacugauacagaacgaucg

SEQ ID NO: 5167 - RNA, 23 nt, Homo sapiens
aaaagagaaaguguuuuauauac

SEQ ID NO: 5168 - RNA, 23 nt, Homo sapiens
aaaagagaaaguguuuuauauac

SEQ ID NO: 5169 - RNA, 23 nt, Homo sapiens
aaaagagaaaguguuuuauauac

SEQ ID NO: 5170 - RNA, 23 nt, Homo sapiens
ggaauuggauucgccauuuuauu

SEQ ID NO: 5171 - RNA, 23 nt, Homo sapiens
ggaauuggauucgccauuuuauu

SEQ ID NO: 5172 - RNA, 23 nt, Homo sapiens
ggaauuggauucgccauuuuauu

SEQ ID NO: 5173 - RNA, 23 nt, Homo sapiens
cgacagaacaguccuuaauccag

SEQ ID NO: 5174 - RNA, 23 nt, Homo sapiens
cgacagaacaguccuuaauccag

SEQ ID NO: 5175 - RNA, 23 nt, Homo sapiens
cgacagaacaguccuuaauccag

SEQ ID NO: 5176 - RNA, 23 nt, Homo sapiens
gaacaguccuuaauccagaaacc

SEQ ID NO: 5177 - RNA, 23 nt, Homo sapiens
gaacaguccuuaauccagaaacc

SEQ ID NO: 5178 - RNA, 23 nt, Homo sapiens
gaacaguccuuaauccagaaacc

SEQ ID NO: 5179 - RNA, 23 nt, Homo sapiens
ucaccaggaaagacugauacaga

SEQ ID NO: 5180 - RNA, 23 nt, Homo sapiens
ucaccaggaaagacugauacaga

SEQ ID NO: 5181 - RNA, 23 nt, Homo sapiens
ucaccaggaaagacugauacaga

SEQ ID NO: 5182 - RNA, 23 nt, Homo sapiens
ucaccaugcagauuaugcggauc

SEQ ID NO: 5183 - RNA, 23 nt, Homo sapiens
ucaccaugcagauuaugcggauc

SEQ ID NO: 5184 - RNA, 23 nt, Homo sapiens
ucaccaugcagauuaugcggauc

SEQ ID NO: 5185 - RNA, 23 nt, Homo sapiens
acagaacaguccuuaauccagaa

SEQ ID NO: 5186 - RNA, 23 nt, Homo sapiens
acagaacaguccuuaauccagaa

SEQ ID NO: 5187 - RNA, 23 nt, Homo sapiens
acagaacaguccuuaauccagaa

SEQ ID NO: 5188 - RNA, 23 nt, Homo sapiens
ugagauguaucuuuugcucucuc

SEQ ID NO: 5189 - RNA, 23 nt, Homo sapiens
ugagauguaucuuuugcucucuc

SEQ ID NO: 5190 - RNA, 23 nt, Homo sapiens
ugagauguaucuuuugcucucuc

SEQ ID NO: 5191 - RNA, 23 nt, Homo sapiens
gaagauuagagaguuuuauuucu

SEQ ID NO: 5192 - RNA, 23 nt, Homo sapiens
gaagauuagagaguuuuauuucu

SEQ ID NO: 5193 - RNA, 23 nt, Homo sapiens
gaagauuagagaguuuuauuucu

SEQ ID NO: 5194 - RNA, 23 nt, Homo sapiens
ugauacagaacgaucgauacaga

SEQ ID NO: 5195 - RNA, 23 nt, Homo sapiens
ugauacagaacgaucgauacaga

SEQ ID NO: 5196 - RNA, 23 nt, Homo sapiens
ugauacagaacgaucgauacaga

SEQ ID NO: 5197 - RNA, 23 nt, Homo sapiens
ccaugcagauuaugcggaucaaa

SEQ ID NO: 5198 - RNA, 23 nt, Homo sapiens
ccaugcagauuaugcggaucaaa

SEQ ID NO: 5199 - RNA, 23 nt, Homo sapiens
ccaugcagauuaugcggaucaaa

SEQ ID NO: 5200 - RNA, 23 nt, Homo sapiens
gaauuggauucgccauuuuauuu

SEQ ID NO: 5201 - RNA, 23 nt, Homo sapiens
gaauuggauucgccauuuuauuu

SEQ ID NO: 5202 - RNA, 23 nt, Homo sapiens
gaauuggauucgccauuuuauuu

SEQ ID NO: 5203 - RNA, 23 nt, Homo sapiens
uccaacaucaccaugcagauuau

SEQ ID NO: 5204 - RNA, 23 nt, Homo sapiens
uccaacaucaccaugcagauuau

SEQ ID NO: 5205 - RNA, 23 nt, Homo sapiens
uccaacaucaccaugcagauuau

SEQ ID NO: 5206 - RNA, 23 nt, Homo sapiens
gacagaacaguccuuaauccaga

SEQ ID NO: 5207 - RNA, 23 nt, Homo sapiens
gacagaacaguccuuaauccaga

SEQ ID NO: 5208 - RNA, 23 nt, Homo sapiens
gacagaacaguccuuaauccaga

SEQ ID NO: 5209 - RNA, 23 nt, Homo sapiens
aacaucaccaugcagauuaugcg

SEQ ID NO: 5210 - RNA, 23 nt, Homo sapiens
aacaucaccaugcagauuaugcg

SEQ ID NO: 5211 - RNA, 23 nt, Homo sapiens
aacaucaccaugcagauuaugcg

SEQ ID NO: 5212 - RNA, 23 nt, Homo sapiens
ucccucuuggaauuggauucgcc

SEQ ID NO: 5213 - RNA, 23 nt, Homo sapiens
ucccucuuggaauuggauucgcc

SEQ ID NO: 5214 - RNA, 23 nt, Homo sapiens
ucccucuuggaauuggauucgcc

SEQ ID NO: 5215 - RNA, 23 nt, Homo sapiens
uccuacagcacaacaaaugugaa

SEQ ID NO: 5216 - RNA, 23 nt, Homo sapiens
uccuacagcacaacaaaugugaa

SEQ ID NO: 5217 - RNA, 23 nt, Homo sapiens
uccuacagcacaacaaaugugaa

SEQ ID NO: 5218 - RNA, 23 nt, Homo sapiens
gacugauacagaacgaucgauac

SEQ ID NO: 5219 - RNA, 23 nt, Homo sapiens
gacugauacagaacgaucgauac

SEQ ID NO: 5220 - RNA, 23 nt, Homo sapiens
gacugauacagaacgaucgauac

SEQ ID NO: 5221 - RNA, 23 nt, Homo sapiens
gagaaaguguuuuauauacggua

SEQ ID NO: 5222 - RNA, 23 nt, Homo sapiens
gagaaaguguuuuauauacggua

SEQ ID NO: 5223 - RNA, 23 nt, Homo sapiens
gagaaaguguuuuauauacggua

SEQ ID NO: 5224 - RNA, 23 nt, Homo sapiens
aagagaaaguguuuuauauacgg

SEQ ID NO: 5225 - RNA, 23 nt, Homo sapiens
aagagaaaguguuuuauauacgg

SEQ ID NO: 5226 - RNA, 23 nt, Homo sapiens
aagagaaaguguuuuauauacgg

SEQ ID NO: 5227 - RNA, 23 nt, Homo sapiens
uggauucgccauuuuauuuuucu

SEQ ID NO: 5228 - RNA, 23 nt, Homo sapiens
uggauucgccauuuuauuuuucu

SEQ ID NO: 5229 - RNA, 23 nt, Homo sapiens
uggauucgccauuuuauuuuucu

SEQ ID NO: 5230 - RNA, 23 nt, Homo sapiens
caguccuuaauccagaaaccuga

SEQ ID NO: 5231 - RNA, 23 nt, Homo sapiens
caguccuuaauccagaaaccuga

SEQ ID NO: 5232 - RNA, 23 nt, Homo sapiens
caguccuuaauccagaaaccuga

SEQ ID NO: 5233 - RNA, 23 nt, Homo sapiens
aaguguuuuauauacgguacuua

SEQ ID NO: 5234 - RNA, 23 nt, Homo sapiens
aaguguuuuauauacgguacuua

SEQ ID NO: 5235 - RNA, 23 nt, Homo sapiens
aaguguuuuauauacgguacuua

SEQ ID NO: 5236 - RNA, 23 nt, Homo sapiens
aauagacauugcuauucuguuuu

SEQ ID NO: 5237 - RNA, 23 nt, Homo sapiens
aauagacauugcuauucuguuuu

SEQ ID NO: 5238 - RNA, 23 nt, Homo sapiens
aauagacauugcuauucuguuuu

We claim:

1. A double stranded ribonucleic acid (dsRNA) agent for inhibiting expression of vascular endothelial growth factor A (VEGF-A), wherein the dsRNA agent comprises a sense strand and an antisense strand forming a double stranded region, wherein the antisense strand comprises nucleotide sequence VPusCfsugga(Tgn)uaaggaCfuGfuucugsusc (SEQ ID NO: 4178), and wherein the sense strand comprises nucleotide sequence csasgaa(Chd)AfoUfCfCfuuaauccasgsa (SEQ ID NO: 4166), wherein VP is a 5'-vinyl phosphonate;

s is a phosphorothioate linkage;

a, c, g, and u are 2'-O-methyl (2'-OMe) A, C, G, and U, respectively;

Tgn is thymidine-glycol nucleic acid (GNA)S-Isomer;

Chd is 2'-O-hexadecyl-cytidine-3'-phosphate; and

Af, Cf, Gf, and Uf are 2'-fluoro A, C, G, and U, respectively.

2. The dsRNA agent of claim 1, wherein the sense strand consists of the nucleotide sequence csasgaa(Chd) AfoUfCfCfuuaauccasgsa (SEQ ID NO: 4166), and the antisense strand consists of the nucleotide sequence VPusCfsugga(Tgn)uaaggaCfuGfuucugsusc (SEQ ID NO: 4178).

3. A cell containing the dsRNA agent of claim 2.

4. A pharmaceutical composition for inhibiting expression of a VEGF-A, comprising the dsRNA agent of claim 2.

5. The dsRNA agent of claim 1, wherein at least one of the sense strand and the antisense strand is conjugated to one or more lipophilic moieties.

6. The dsRNA agent of claim 5, wherein the one or more lipophilic moieties is conjugated via a linker or carrier.

7. The dsRNA agent of claim 5, wherein the one or more lipophilic moieties is conjugated to one or more internal positions on at least one strand.

8. The dsRNA agent of claim 7, wherein the one or more lipophilic moieties is conjugated to one or more internal positions on at least one strand via a linker or carrier.

9. The dsRNA agent of claim 5, wherein (a) the one or more lipophilic moieties is an aliphatic, alicyclic, or polyalicyclic compound;

(b) the one or more lipophilic moieties contains a saturated or unsaturated C16 hydrocarbon chain;

(c) the one or more lipophilic moieties is conjugated via a carrier that replaces one or more nucleotide(s) in the internal position(s) or the double stranded region;

(d) the one or more lipophilic moieties is conjugated to the sense strand or the antisense strand via a linker containing an ether, thioether, urea, carbonate, amine, amide, maleimide-thioether, disulfide, phosphodiester, sulfonamide linkage, a product of a click reaction, or carbamate; and/or (e) the one or more lipophilic moieties is conjugated to a nucleobase, sugar moiety, or internucleosidic linkage.

10. The dsRNA agent of claim 1, wherein at least one strand comprises a 3' overhang of at least 2 nucleotides.

11. A cell containing the dsRNA agent of claim 1.

12. A pharmaceutical composition for inhibiting expression of a VEGF-A, comprising the dsRNA agent of claim 1.

13. A method of inhibiting expression of VEGF-A in a cell, the method comprising:

(a) introducing into the cell the dsRNA agent of claim 1; and (b) maintaining the cell produced in step (a) for a time sufficient to reduce levels of VEGF-A mRNA, VEGF-A protein, or both of VEGF-A mRNA and protein, thereby inhibiting expression of VEGF-A in the cell.

14. The method of claim 13, wherein the cell is within a subject.

15. The method of claim 14, wherein (a) the subject is a human; and/or (b) the subject has been diagnosed with a VEGF-A-associated disorder, e.g., wet age-related macular degeneration (wet AMD), diabetic retinopathy (DR), diabetic macular edema (DME), retinal vein occlusion (RVO), macular edema following retinal vein occlusion (MEfRVO), retinopathy of prematurity (ROP), or myopic choroidal neovascularization (mCNV).

16. A method of treating a subject diagnosed with a VEGF-A-associated disorder comprising administering to the subject a therapeutically effective amount of the dsRNA agent of claim 1, thereby treating the disorder.

17. The method of claim 16, wherein (a) the VEGF-A-associated disorder is an angiogenic ocular disorder;

(b) the VEGF-A-associated disorder is an angiogenic ocular disorder selected from the group consisting of AMD, DR, DME, RVO, MEfRVO, ROP, and mCNV;

(c) the treating comprises amelioration of at least one sign or symptom of the disorder;

(d) the treating comprises inhibiting angiogenesis, inhibiting or reducing the expression or activity of VEGF A, inhibiting choroidal neovascularization, inhibiting growth of new blood vessels in the choriocapillaris, reducing retinal thickness, increasing visual acuity, or reducing intraocular inflammation;

(e) the dsRNA agent is administered to the subject intraocularly, intravenously, or topically;

(f) the dsRNA agent is administered to the subject intraocularly and the intraocular administration comprises intravitreal administration (e.g., intravitreal injection), transscleral administration (e.g., transscleral injection), subconjunctival administration (e.g., subconjunctival injection), retrobulbar administration (e.g., retrobulbar injection), intracameral administration (e.g., intracameral injection), or subretinal administration (e.g., subretinal injection); and/or (g) the method further comprises administering to the subject an additional agent or therapy suitable for treatment or prevention of an VEGF-A-associated disorder (e.g., one or more of a photodynamic therapy, photocoagulation therapy, a steroid, a non-steroidal anti-inflammatory agent, an anti-VEGF agent, or a vitrectomy).

18. The dsRNA agent of claim 1, wherein the dsRNA agent further comprises a targeting ligand.

19. The dsRNA agent of claim 18, wherein the targeting ligand targets an ocular tissue.

20. The dsRNA agent of claim 19, wherein the ocular tissue is a retinal pigment epithelium (RPE) or choroid tissue.

* * * * *